(12) United States Patent
Ikiz et al.

(10) Patent No.: US 10,285,387 B2
(45) Date of Patent: May 14, 2019

(54) NON-HUMAN ANIMAL EXHIBITING DIMINISHED UPPER AND LOWER MOTOR NEURON FUNCTION AND SENSORY PERCEPTION

(71) Applicant: Regeneron Pharmaceuticals, Inc., Tarrytown, NY (US)

(72) Inventors: Burcin Ikiz, New York, NY (US); Michael LaCroix-Fralish, Yorktown Heights, NY (US); Susan D. Croll, Putnam Valley, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 95 days.

(21) Appl. No.: 15/072,286

(22) Filed: Mar. 16, 2016

(65) Prior Publication Data

US 2016/0270377 A1    Sep. 22, 2016

Related U.S. Application Data

(60) Provisional application No. 62/133,909, filed on Mar. 16, 2015, provisional application No. 62/250,229, filed on Nov. 3, 2015.

(51) Int. Cl.
| *A01K 67/027* | (2006.01) |
| *A01K 67/033* | (2006.01) |
| *G01N 33/00* | (2006.01) |
| *C07K 14/705* | (2006.01) |
| *G01N 33/50* | (2006.01) |

(52) U.S. Cl.
CPC ...... *A01K 67/0276* (2013.01); *A01K 67/0278* (2013.01); *C07K 14/70578* (2013.01); *G01N 33/5058* (2013.01); *G01N 33/5088* (2013.01); *A01K 2217/075* (2013.01); *A01K 2217/077* (2013.01); *A01K 2227/105* (2013.01); *A01K 2267/0318* (2013.01); *A01K 2267/0393* (2013.01); *C07K 2319/02* (2013.01); *C07K 2319/03* (2013.01); *C07K 2319/61* (2013.01); *G01N 2500/00* (2013.01); *G01N 2800/28* (2013.01)

(58) Field of Classification Search
CPC .................................................. A01K 67/0276
USPC .................................................. 800/3, 8, 18
See application file for complete search history.

(56) References Cited

U.S. PATENT DOCUMENTS

| 6,358,508 | B1 | 3/2002 | Ni et al. |
|---|---|---|---|
| 6,586,251 | B2 | 7/2003 | Economides et al. |
| 6,596,541 | B2 | 7/2003 | Murphy et al. |
| 6,667,390 | B2 | 12/2003 | Ni et al. |
| 6,919,078 | B2 | 7/2005 | Ni et al. |
| 6,949,358 | B1 | 9/2005 | Ni et al. |
| 7,105,348 | B2 | 9/2006 | Murphy et al. |
| 7,294,754 | B2 | 11/2007 | Poueymirou et al. |
| 7,576,259 | B2 | 8/2009 | Poueymirou et al. |
| 7,612,250 | B2 | 11/2009 | Overstrom et al. |
| 7,659,442 | B2 | 2/2010 | Poueymirou et al. |
| 8,354,389 | B2 | 1/2013 | Frendewey et al. |
| 8,518,392 | B2 | 8/2013 | Frendewey et al. |
| 8,697,851 | B2 | 4/2014 | Frendewey et al. |
| 8,946,504 | B2 | 2/2015 | Frendewey et al. |
| 8,946,505 | B2 | 2/2015 | Frendewey et al. |
| 9,096,870 | B2 | 8/2015 | Frendewey et al. |
| 9,267,152 | B2 | 2/2016 | Frendewey et al. |
| 2004/0177390 | A1 | 9/2004 | Lewis et al. |
| 2005/0069540 | A1 | 3/2005 | Liu et al. |
| 2008/0078000 | A1 | 3/2008 | Poueymirou et al. |
| 2008/0092249 | A1 | 4/2008 | Lewis et al. |
| 2010/0203044 | A1 | 8/2010 | Nikolaev et al. |
| 2011/0104799 | A1 | 5/2011 | Economides et al. |
| 2012/0076785 | A1* | 3/2012 | Nikolaev ............... C07K 16/18 424/134.1 |
| 2013/0309670 | A1 | 11/2013 | Frendewey et al. |
| 2013/0312129 | A1 | 11/2013 | Frendewey et al. |
| 2014/0235933 | A1 | 8/2014 | Lee et al. |
| 2014/0309487 | A1 | 10/2014 | Lee et al. |
| 2014/0310828 | A1 | 10/2014 | Lee et al. |
| 2015/0159174 | A1 | 6/2015 | Frendewey et al. |
| 2015/0159175 | A1 | 6/2015 | Frendewey et al. |

FOREIGN PATENT DOCUMENTS

| AU | 2009319864 A2 | 6/2010 |
|---|---|---|
| WO | 1998/010059 A1 | 3/1998 |
| WO | 1999/005266 A2 | 2/1999 |

(Continued)

OTHER PUBLICATIONS

Aebischer et al., (2013) "Death Receptors in the Selective Degeneration of Motoneurons in Amyotrophic Lateral Sclerosis," J. Neurodegener. Dis., 746845, doi:10.1155/2013/746845.

Arber et al., (1999) "Requirement for the homeobox gene Hb9 in the consolidation of motor neuron identity," Neuron, 23:659-674.

Armstrong et al., (1983) "Distribution of cholinergic neurons in rat brain: demonstrated by the immunocytochemical localization of choline acetyltransferase," J. Comp. Neural., 216:53-68, doi:10.1002/cne.902160106.

(Continued)

*Primary Examiner* — Valarie E Bertoglio

(74) *Attorney, Agent, or Firm* — FisherBroyles, LLP; Rita S. Wu; Yongjin Choi

(57) ABSTRACT

An animal model for motor neuron dysfunction in disease, e.g., amyotrophic lateral sclerosis (ALS), comprising a genetically modified non-human animal that comprises a genetically modified DR6 allele and exhibits normal phenotypes at birth and for a few weeks or months after birth. However, as the non-human animal ages, it develops motor neuron dysfunction that presents as one or more ALS-like symptoms, which may progress rapidly after onset. Methods of identifying candidate agents that may be used to prevent, delay or treat ALS are also provided.

21 Claims, 79 Drawing Sheets

Specification includes a Sequence Listing.

(56) References Cited

FOREIGN PATENT DOCUMENTS

| | | |
|---|---|---|
| WO | 2002/036789 A2 | 5/2002 |
| WO | 2008/017234 A1 | 2/2008 |
| WO | 2008/080045 A2 | 7/2008 |
| WO | 2009/114400 A1 | 9/2009 |
| WO | 2009/152463 A1 | 12/2009 |
| WO | 2010/062904 A2 | 6/2010 |
| WO | 2015/088643 A1 | 6/2015 |

OTHER PUBLICATIONS

Ashkenazi & Dixit (1998) "Death receptors: signaling and modulation," Science, 281:1305-1308.

Benschop & Wei (2009) "Tumor necrosis factor receptor superfamily member 21: TNFR-related death receptor-6, DR6," Adv. Exp. Med. Biol., 647:186-194, doi:10.1007/978-0-387-89520-8_13.

Boillee et al., (2006) "Onset and progression in inherited ALS determined by motor neurons and microglia," Science, 312:1389-1392, doi:10.1126/science.1123511.

Cleveland & Rothstein (2001) "From Charcot to Lou Gehrig: deciphering selective motor neuron death in ALS," Nat. Rev. Neurosci., 2:806-819, doi:10.1038/35097565.

Fulop & Phillips (1990) "The scid mutation in mice causes a general defect in DNA repair," Nature, 347:479-482, doi:10.1038/347479a0.

Guicciardi & Gores (2009) "Life and death by death receptors," FASEB J., 23:1625-1637, doi:10.1096/fj.08-111005.

Haase et al., (2008) "Signaling by death receptors in the nervous system," Curr. Opin. Neurobiol., 18:284-291, doi:10.1016/j.conb.2008.07.013.

Hatzipetros et al., (2015) "A Quick Phenotypic Neurological Scoring System for Evaluating Disease Progression in the SOD1-G93A Mouse Model of ALS," J. Vis. Exp., doi:10.3791/53257.

Heng et al., (2008) "Immunological Genome Project, C. The Immunological Genome Project: networks of gene expression in immune cells," Nat. Immunol., 9:1091-1094, doi:10.1038/ni1008-1091.

Kallop et al., (2014) "A death receptor 6-amyloid precursor protein pathway regulates synapse density in the mature CNS but does not contribute to Alzheimer's disease-related pathophysiology in murine models," J. Neurosci., 34:6425-6437, doi:10.1523/JNEUROSCI.4963-13.2014.

Kupershmidt et al., (2010) "Ontology-based meta-analysis of global collections of high-throughput public data," PLoS One, 5, doi:10.1371/journal.pone.0013066.

Love et al., (2014) "Moderated estimation of fold change and dispersion for RNA-seq data with DESeq2," Genome Biol., 15:550, doi:10.1186/s13059-014-0550-8.

Luo & O'Leary (2005) "Axon retraction and degeneration in development and disease," Annu. Rev. Neurosci., 28:127-156, doi:10.1146/annurev.neuro.28.061604.135632.

McGoldrick et al., (2013) "Rodent models of amyotrophic lateral sclerosis," Biochim. Biophys. Acta., 1832:1421-1436, doi:10.1016/j.bbadis.2013.03.012.

Mulder (1982) "Clinical limits of amyotrophic lateral sclerosis," Adv. Neurol., 36:15-22.

Nagata (1997) "Apoptosis by death factor," Cell, 88:355-365.

Nikodemova et al., (2014) "Spinal but not cortical microglia acquire an atypical phenotype with high VEGF, galectin-3 and osteopontin, and blunted inflammatory responses in ALS rats," Neurobiol. Dis., 69:43-53, doi:10.1016/j.nbd.2013.11.009.

Okamoto et al., (2008) "Bunina bodies in amyotrophic lateral sclerosis," Neuropathology, 28:109-115, doi:10.1111/i.1440-1789.2007.00873.x.

Olsen et al. (2014) "Genetic analysis reveals that amyloid precursor protein and death receptor 6 function in the same pathway to control axonal pruning independent of beta-secretase," J. Neurosci., 34:6438-6447, doi:10.1523/Jneurosci.3522-13.2014.

Philips & Robberecht (2011) "Neuroinflammation in amyotrophic lateral sclerosis: role of glial activation in motor neuron disease," Lancet Neural., 10:253-263, doi:10.1016/S1474-4422(11)70015-1.

Raoul et. al., (1999) "Programmed cell death of embryonic motoneurons triggered through the Fas death receptor," J. Cell. Biol., 147:1049-1062.

Rowland & Shneider (2001) "Amyotrophic lateral sclerosis," N. Engl. J. Med., 344:1688-1700, doi:10.1056/NEJM200105313442207.

Sasaki et al., (1988) "Swelling of neuronal processes in motor neuron disease," Neurology, 38:1114-1118.

Tada et al., (2011) "Deleterious effects of lymphocytes at the early stage of neurodegeneration in an animal model of amyotrophic lateral sclerosis," J. Neuroinflammation, 8:19, doi:10.1186/1742-2094-8-19.

Van Den Bosch et al., (2006) "The role of excitotoxicity in the pathogenesis of amyotrophic lateral sclerosis," Biochim. Biophys. Acta., 1762:1068-1082, doi:10.1016/j.bbadis.2006.05.002.

Valenzuela et al., (2003) "High-throughput engineering of the mouse genome coupled with high-resolution expression analysis," Nat. Biotechnol., 21:652-659, doi:10.1038/nbt822.

Wijesekera & Leigh (2009) "Amyotrophic lateral sclerosis," Orphanet. J. Rare Dis., 4:3, doi:10.1186/1750-1172-4-3.

Xu et al., (2015) "Beta amyloid-induced upregulation of death receptor 6 accelerates the toxic effect of N-terminal fragment of amyloid precursor protein," Neurobiol. Aging, 36:157-168, doi:10.1016/j.neurobiolaging.2014.07.027.

Zeisel et al., (2015) "Brain structure. Cell types in the mouse cortex and hippocampus revealed by single-cell RNA-seq," Science, 347:1138-1142, doi:10.1126/science.aaa1934.

Dennis (2002) "Welfare issues of genetically modified animals," ILAR Journal, 43(2):100-109, Abstract Only.

Zhou et al., (2009) "Developing tTA transgenic rats for inducible and reversible gene expression," International Journal of Biological Sciences, 5:171-181.

Adams et al., (2005) "A genome-wide, end-sequenced 129Sv BAC library resource for targeting vector construction," Genomics, 86:753-758.

Aguzzi et al., (2001) "Interventional strategies against prion diseases," Nature Reviews, 2:745-749.

Bachetti et al., (1977) "Transfer of the gene for thymidine kinase to thymidine kinase-deficient human cells by purified herpes simplex viral DNA," PNAS USA, 74(4):1590-1594.

Derosa et al., (2008) Tumor-derived death receptor 6 modulates dendritic cell development, Cancer Immunol Immunother, 57:777-787.

Dechiara et al., (2009) "VelociMouse: Fully ES Cell-Derived FO-Generation Mice Obtained from the Injection of ES into Eight-Cell-Stage Embryos," Methods Mol. Biol., 530:311-324.

Frendewey et al., (2010) "Chapter 17—The Loss-of-Allele Assay for ES Cell Screening and Mouse Genotyping," Methods in Enzymology, 476:295-307.

Friese et al., (2014) Mechanisms of neurodegeneration and axonal dysfunction in multiple sclerosis, Nature Reviews, 10:225-238.

Graham et al., (1973) "A New Technique for the Assay of the Infectivity of Human Adenovirus 5 DNA," Virology, 52 (2):456-467.

http://sbfnl.stanford.edu/cs/bm/sm/bmst_catwalk.html.

Hu et al., (2013) "A DR6/p75NTR complex is responsible for β-amyloid-induced cortical neuron death," Cell Death and Disease, 4, e579.

Hu et al., (2014) "Agonist antibody activates death receptor 6 downstream signaling involving TRADD recruitment," FEBS Letters, 588:401-407.

Huang et al., (2013) "Death receptor 6 (DR6) antagonist antibody is neuroprotective in the mouse SOD1 G93A model of amyotrophic lateral sclerosis," Cell Death and Disease, 4, e841.

Kawamata and Ochiya (2010) Generation of genetically modified rats from embryonic stem cells, PNAS, 107 (32):14223-14228.

Kuester et al., (2011) "The Crystal Structure of Death Receptor 6 (DR6): A Potential Receptor of the Amyloid Precursor Protein (APP)," Journal of Molecular Biology, 409:189-201.

Liu et al., (2001) "Enhanced CD4+ T Cell Proliferation and and Th2 Cytokine Production in DR6-Deficient Mice," Immunity, 15:23-34.

(56) References Cited

OTHER PUBLICATIONS

Lum et al., (2010) "Orphan receptor GPR110, an oncogene overexpressed in lung and prostate cancer," BMC Cancer, 10:40.
Marik et al., (2013) "Death Receptor 6 Regulates Adult Experience-Dependent Cortical Plasticity," Journal of Neuroscience, 33(38):14998-15003.
Mi et al., (2011) "Death receptor 6 negatively regulates oligodendrocyte survival, maturation and myelination," Nature Medicine, 17(7):816-822.
Nikolaev et al., (2009) "APP binds DR6 to trigger axon pruning and neuron death via distinct caspases," Nature, 457:981-990.
Pan et al., (1998) "Identification and functional characterization of DR6, a novel death domain-containing TNF receptor," FEBS Letters 431:351-356.
Perrin (2014) "Make mouse studies work," Nature, 507:423-425.
Ponomarev and Audie (2011) "Computational prediction and analysis of the DR6—NAPP interaction," Proteins, 1376-1395.
Poueymirou et al., (2007) "F0 generation mice fully derived from gene-targeted embryonic stem cells allowing immediate phenotypic analyses," Nat. Biotechnol., 25:91-99.
Sasaroli et al., (2011) "Novel surface targets and serum biomarkers from the ovarian cancer vasculature," Cancer Biology & Therapy, 12(3):169-180.
Schmidt et al., (2003) "Enhanced B Cell Expansion, Survival and Humoral Responses by Targeting Death Receptor 6," Journal of Experimental Medicine, 197(1):51-62.
Schmidt et al., (2005) "Resistance to Myelin Oligodendrocyte Glycoprotein-Induced Experimental Autoimmune Encephalomyelitis by Death Receptor 6-Deficient Mice," J. Immunol., 175(4):2286-2292.
Schwartz et al., (2012) "Glutamate neurocircuitry: theoretical underpinnings in schizophrenia," Frontiers in Pharmacology, 3(195):1-11.
Shen et al. (2012) "A map of the cis-regulatory sequences in the mouse genome" Nature 488(7409):116-120.
Tam et al., (2012) "Death Receptors DR6 and TROY Regulate Brain Vascular Development," Developmental Cell, 22 (2):403-417.
Valenzuela et al., (2003) "High-throughput engineering of the mouse genome coupled with high-resolution expression analysis," Nature Biotechnology, 21(6):652-659.
Wang et al., (2015) "Death Receptor 6 and Caspase-6 Regulate Prion Peptide-Induced Axonal Degeneration in Rat Spinal Neurons," J. Mol. Neurosci, 56:966-976.
Yamamoto et al., (2012) "Derivation of rat embryonic stem cells and generation of protease-activated receptor-2 knockout rats," Transgenic Res., 21:743-755.
Yang et al., (2012) "DR6 as a Diagnostic and Predictive Biomarker in Adult Sarcoma," PLoS ONE, 7(5):1-8.
Zhao et al., (2001) "Impared cJun Amino Terminal Kinase Activity and T Cell Differentiation in Death Receptor 6-deficient Mice," J. Exp. Med., 194:1441-1448.
Chandramouli et al., (2013) "Ltbp1L is focally induced in embryonic mammary mesenchyme, demarcates the ductal luminal lineage and is upregulated during involution," Breast Cancer Research, 15(6):R111, Figure 1.
International Search Report and Written Opinion with Respect to PCT/US2016/022685, dated Jun. 15, 2016.

\* cited by examiner

NON-HUMAN ANIMAL EXHIBITING DIMINISHED UPPER AND LOWER MOTOR NEURON FUNCTION AND SENSORY PERCEPTION

CROSS-REFERENCE TO RELATED APPLICATIONS

This application claims the benefit under 35 U.S.C. § 119(e) of U.S. Provisional Application Ser. No. 62/133,909 (filed Mar. 16, 2015) and 62/250,229 (filed Nov. 3, 2015), each application of which is hereby incorporated by reference.

SEQUENCE LISTING

The official copy of the sequence listing is submitted electronically via EFS-Web as an ASCII formatted sequence listing with a file named 2016-03-16-T0041US01-SEQ-LIST_ST25.txt, created on Mar. 16, 2016, and having a size of about 685 kilobytes, and is filed concurrently with the specification. The sequence listing contained in this ASCII formatted document is part of the specification and is herein incorporated by reference in its entirety.

TECHNICAL FIELD

The present application relates generally to a non-human animal that develops diminished upper motor neuron, lower motor neuron, and/or sensory perception over time, which animal may provide a useful model for neurodegenerative disorder, e.g., a motor neuron disease, such as amyotrophic lateral sclerosis (ALS).

BACKGROUND OF THE INVENTION

Amyotrophic lateral sclerosis (ALS), also known as Lou Gehrig's Disease, is a fatal neurodegenerative disease resulting from the destruction of motor neurons in the spinal cord, brainstem and cortex that are responsible for voluntary movement. This disease clinically manifests as progressive muscular weakness and atrophy, leading to paralysis and death within 3-5 years of disease onset.

Approximately 20,000 people in the United States have ALS, and 5,000 people are diagnosed with ALS each year. ALS is common worldwide, affecting people of all races and ethnic backgrounds. The average age of onset of ALS is between 40 and 60 years of age, but ALS can strike both younger and older men and women. In 90-95% of ALS cases, the disease is apparently random (known as sporadic ALS (sALS)). In such SALS cases, there is no family history of the disease and no clearly associated risk factors. In 5-10% of ALS cases there is an inherited genetic link (known as familial ALS (fALS)).

Among the mutations associated with ALS, those in the Copper-Zinc superoxide dismutase (SOD1) gene have long been thought to cause the ALS disease through a toxic gain of function rather than impairment of the antioxidant function of the SOD1 enzyme. Other genes with mutations associated with the fALS include alsin (ALS2), senataxin (ALS4), vesicle associated membrane protein (VAPB, ALS8), Angiogenin and the p150 subunit of dynactin (DCTN1). Recently, more than thirty mutations in the TDP-43-coding region of Tardbp have been identified in ALS patients with or without apparent family history, corresponding to approximately 4% of fALS and less than 1% of sALS. Most patients with TDP-43 mutation(s) develop a classical ALS phenotype without cognitive deficit suggesting an important role of TDP-43 in the development of ALS. Additionally, expanded GGGGCC hexanucleotide repeats in the promoter of the C9ORF72 gene and appear as a very common cause of fALS and sALS, as well as ALS associated frontotemporal dementia (ALS-FTD).

Several mouse models have been established for ALS disease, which include strains of rodents having mutations in SOD1, TDP43, or FUS, ALS2-knockout mice, and mice with genetically engineered genes coding for the neurofilament subunits. Among these, the human mutant SOD1 (mSOD1) transgenic mouse model is currently the most widely used one because it shares several clinical phenotypes with ALS patients. The first symptom of mSOD1 mice is a fine "jittering/tremor" in one or more of the limbs, which appears at approximately 90 to 100 days of age. At later stages, the mice begin a clinical course, first with muscle weakness and/or paresis in the hind limbs, followed by ascent of paresis to the forelimbs and finally severe quadriplegia. None of the current animal models, however, translate to human disease in that the animals do not exhibit upper motor neuron symptoms, TDP43 and/or SOD1 aggregates, and/or non-motor neuron loss. Accordingly, an animal model that more closely reflects ALS in humans is needed.

SUMMARY OF THE INVENTION

Provided herein is a genetically modified non-human animal that develops conditions symptomatic of dysfunction of the upper motor neurons, lower motor neurons, and/or sensory perception, and as such, may be useful as model for one or more neurodegenerative diseases that affect motor neurons, such as amyotrophic lateral sclerosis (ALS), primary lateral sclerosis, primary lateral sclerosis, progressive muscular dystrophy, etc. Specifically, provided herein is a rodent, e.g., a rat or a mouse, comprising a modified endogenous DR6 locus, wherein the modified DR6 locus lacks (e.g., does not comprise, is absent of, etc.) a first nucleotide (e.g., a first DNA, a first cDNA, a first genomic DNA, etc.) sequence that encodes a DR6 cytoplasmic death domain, or a DR6 cytoplasmic domain, in its entirety, e.g., the modified DR6 locus lacks a nucleotide sequence that encodes any portion of a DR6 cytoplasmic death domain, or a DR6 cytoplasmic domain. The modified DR6 locus may further lack (i) a second nucleotide (e.g., a second cDNA, a second DNA, a second genomic DNA) sequence that encodes a DR6 transmembrane domain in its entirety, e.g., a second nucleotide sequence encoding any portion of a DR6 transmembrane domain; (ii) a third nucleotide (e.g., a third cDNA, a third DNA, a third genomic DNA) sequence encoding a DR6 extracellular domain, or any portion thereof, e.g., a third nucleotide sequence that encodes any portion of a DR6 extracellular domain (iii) a fourth nucleotide sequence, e.g., a fourth genomic sequence spanning from the entirety of exon 3 to the entirety of exon 6, including intervening introns, of the endogenous rodent DR6 gene; and/or (iv) a fifth nucleotide sequence, e.g., a fourth genomic sequence, spanning from part of exon 2, e.g., base 4103, to the entirety of exon 6, e.g., the stop codon, including intervening introns, of the endogenous rodent DR6 gene, wherein the fifth nucleotide sequence encodes the full-length and mature endogenous rodent DR6 protein. In some embodiments, the rodent is a mouse and the modified DR6 allele lacks a first nucleotide sequence encoding a DR6 cytoplasmic death domain, e.g., the modified DR6 allele lacks a first nucleotide sequence encoding amino acids 388-454 of SEQ ID NO:15, or any portion thereof. In some embodiments, provided is a mouse comprising a modified DR6 allele lacking a nucleotide sequence encoding a cytoplasmic domain, e.g., a cytoplasmic domain having the amino acid sequence set forth as amino acids 330-614 of SEQ ID NO:15. In some embodiments, a mouse provided herein comprises a modified DR6 allele lacking a nucleotide sequence encoding a mature DR6 protein, e.g., as set forth as amino acids 1-614 of SEQ ID NO:15. In some embodiments, the modified DR6 allele lacks more than 5 kb of an endogenous genomic sequence. In some embodiments, the modified DR6 allele lacks more than 10 kb of an endogenous genomic sequence. In some embodiments, the modified DR6 allele lacks more than 20 kb of an endogenous genomic sequence. In some embodiments, the modified DR6 allele lacks more than 30 kb of an endogenous genomic sequence. In some embodiments, the modified DR6 allele lacks more than 40 kb of an endogenous genomic sequence. In some embodiments, the modified DR6 allele lacks more than 50 kb of an endogenous genomic sequence. In some embodiments, the rodent is heterozygous or homozygous for the modified DR6 locus lacking a nucleotide sequence encoding any part of an endogenous DR6 extracellular domain, an endogenous transmembrane domain and/or an endogenous DR6 cytoplasmic domain.

A genetically modified rodent as provided herein may express a nucleic acid, e.g., which may be randomly inserted into the rodent's genome or which may be operably linked to an endogenous DR6 transcriptional regulatory sequence, e.g., at an endogenous DR6 locus (e.g., a modified endogenous DR6 locus as described herein), wherein the nucleic acid encodes a polypeptide comprising a functional DR6 signal peptide (e.g., a functional heterologous DR6 signal peptide, a functional endogenous DR6 signal peptide, a functional rat DR6 signal peptide, a functional mouse DR6 signal peptide, etc.), a transmembrane domain (e.g., a DR6 transmembrane domain or a heterologous transmembrane domain (e.g., an ROR1 transmembrane domain)), a reporter protein (e.g., a β-galactosidase protein) or a combination thereof, and wherein the polypeptide lacks (e.g., is not operably fused to, does not comprise, etc.) a functional DR6 cytoplasmic domain, or any portion thereof. In some embodiments, the polypeptide also lacks a functional DR6 extracellular domain, or any portion thereof. In some embodiments, the polypeptide consists essentially or consists of a functional DR6 signal peptide. In some embodiments, the polypeptide consists essentially or consists of a functional DR6 signal peptide operably fused to a transmembrane domain. In some embodiments, the polypeptide consists essentially or consists of a functional DR6 signal peptide operably fused to a transmembrane domain, which is operably fused to a reporter protein. In some embodiments, the polypeptide consists essentially or consists of a functional DR6 signal peptide operably fused to a transmembrane domain. In some embodiments, the polypeptide consists essentially or consists of a transmembrane domain. In some embodiments, the polypeptide consists essentially or consists of a transmembrane domain operably fused to a reporter protein. In some embodiments, the polypeptide consists essentially or consists of a reporter protein. In some embodiments, the DR6 signal peptide is a rodent DR6 signal peptide, e.g., a mouse DR6 signal peptide, e.g., as set forth as amino acids −1 to −41 of SEQ ID NO:15 (or any portion thereof), e.g., is encoded by the sequence set forth as SEQ ID NO:6 or a degenerate variant thereof that encodes the same amino acid sequence but differs from SEQ ID NO:6 only because of the degeneracy of the genetic code. In some embodiments, a rodent as provided herein comprises and expresses a nucleic acid comprising, consisting essentially of, or consisting of a sequence set forth as SEQ ID NO:6 or a degenerate variant thereof that encodes the same amino acid sequence but differs from SEQ ID NO:6 only because of the degeneracy of the genetic code. In some embodiments, the transmembrane domain is an ROR1 transmembrane domain, e.g., is encoded by the sequence set forth as SEQ ID NO:7 or a degenerate variant thereof that encodes the same amino acid sequence but differs from SEQ ID NO:7 only because of the degeneracy of the genetic code. In some embodiments the nucleic acid sequence comprises, consists essentially or, or consists of a sequence set forth as SEQ ID NO:7 or a degenerate variant thereof that encodes the same amino acid sequence but differs from SEQ ID NO:7 only because of the degeneracy of the genetic code. In some embodiments, reporter protein is β-galactosidase, e.g., is encoded by the sequence set forth as SEQ ID NO:8 or a degenerate variant thereof that encodes the same amino acid sequence but differs from SEQ ID NO:8 only because of the degeneracy of the genetic code. In some embodiments, the nucleic acid sequence comprises, consists essentially of or consists of SEQ ID NO:8 or a degenerate variant thereof that encodes the same amino acid sequence but differs from SEQ ID NO:8 only because of the degeneracy of the genetic code. In some embodiments, a rodent as provided herein comprises and expresses a nucleic acid encoding a DR6 signal peptide operably fused to an ROR1 transmembrane domain, which is operably fused to β-galactosidase, e.g., a rodent as provided herein comprises and expresses a nucleic acid sequence set forth as SEQ ID NO:17, or a degenerate variant thereof that encodes the same amino acid sequence but differs from SEQ ID NO:17 only because of the degeneracy of the genetic code.

In some embodiments, the nucleic acid is at an endogenous DR6 locus, optionally operably linked to one or more endogenous DR6 regulatory elements, e.g., an endogenous transcriptional regulatory element, such that the rodent is heterozygous or homozygous for a modified DR6 locus comprising the nucleic acid but lacking at least a nucleotide sequence encoding an endogenous DR6 cytoplasmic domain in its entirety or any portion thereof in its entirety, (e.g., a DR6 cytoplasmic death domain in its entirety), and optionally further lacking an additional nucleotide sequence encoding an endogenous DR6 transmembrane domain or any portion thereof in its entirety and/or an endogenous DR6 extracellular domain in its entirety.

In some embodiments, modification of an endogenous DR6 locus and/or expression of the nucleic acid as described herein affects the function a neuron, a glial cell, or a combination thereof. In some embodiments, expression of the nucleic acid results in diminished function, e.g., dysfunction, of upper and/or lower motor neurons, which may present as, e.g., (a) kyphosis; (b) abnormal hind limb clasping; (c) deficiency in motor coordination and motor learning ability (d) weight loss and (e) diminished sensory perception compared with a control rodent that is of the same genetic background, e.g., is the same strain, as the genetically modified rodent. In some embodiments, a rodent comprising a modified DR6 locus and/or expressing the nucleic acid as described herein may exhibit one or more symptoms of motor neuron dysfunction, e.g., upper motor neuron and/or lower motor neuron dysfunction. In some embodiments, the symptom is (a) kyphosis; (b) abnormal hind limb clasping; (c) deficiency in motor coordination and motor learning ability (d) weight loss and/or (e) diminished sensory perception compared with a control rodent that is of the same genetic background, e.g., is the same strain, as the genetically modified rodent. In some embodiments, the one or more symptoms is an ALS-like symptom involving upper motor neuron dysfunction selected from the group consisting of tremors, spastic paralysis (rigidity), abnormal reflexes, and a combination thereof and/or an ALS-like symptoms involving lower motor neuron dysfunction selected from the group consisting of muscle weakness and wasting, fasciculations, and a combination thereof. Such ALS-like symptoms may be visualized using one or more of blinded subjective ALS-TDI neurological scoring, rotarod testing, catwalk testing, open field testing. Additionally, a rodent as disclosed herein may exhibit reduced weight gain compared to control wild-type animals between 8 and 20 weeks of age. A rodent as disclosed herein may also exhibit a deficient latency to respond to painful stimuli, regardless of whether or not the rodent is exhibiting an diminished motor neuron function that presents as deficient time on a rotarod, impaired locomotor function, diminished catwalk capabilities, and a combination thereof.

In one aspect, the rodent appears may be grossly normal at birth, (e.g., appears normal to the naked eye, e.g., the motor neuron dysfunction and/or diminished sensory perception is not apparent in a blinded subjective neurological scoring assay, rotarod test, catwalk test, open field test, weight measurement and/or pain subjection test) and develops one or more visible ALS-like symptoms as it ages, e.g., the rodent may develop one or more ALS-like symptoms after 2 weeks of age, 3 weeks of age, 4 weeks of age, 5 weeks of age, 6 weeks of age, etc. In one aspect, a rodent as described herein is younger than 4 weeks of age and does not exhibit any ALS-like symptoms. In one aspect, a rodent as described herein is younger than 8 weeks of age and does not exhibit any ALS-like symptoms. In another aspect, the rodent develops ALS-like symptoms before 22 weeks of age. In one embodiment, the rodent is at least 16 weeks of age or older and exhibits one or more of the following phenotypes: (a) kyphosis; (b) abnormal hind limb clasping; (c) deficiency in motor coordination and motor learning ability (d) weight loss and (e) delayed latency to respond to a painful stimulus as compared with a control rodent.

The gene expression patterns of a rodent disclosed herein, e.g., the gene signatures of organs of the nervous system (brain, spinal cord, etc.) may be similar to the gene expression patterns of (1) a patient with ALS or the gene signatures of the patient's organs (brain, spinal cord, etc.), respectively and/or (2) another animal model of ALS, e.g., a SOD1 non-human animal, or the gene signature of the non-human animal's organs (brain, spinal cord, etc), respectively. For example, the gene expression pattern(s) of a brain and/or spinal cord of a rodent disclosed herein may correlate with human ALS biosets and/or murine SOD1 biosets, which may be linked with an immune response. The correlation with the human ALS and/or murine SOD1 biosets suggests that the pathology observed in the rodents disclosed herein is very similar to that seen in humans with ALS or the SOD1 animal model. In some embodiments, a rodent as disclosed herein may have an immune-response linked gene signature, but may not exhibit an abnormal immune response peripherally compared to wild-type rodents.

In one aspect, the number of motor neurons in a rodent as disclosed herein is similar to, e.g., not significantly greater or less than, the number of motor neurons in a wild-type rodent. In some embodiments, the motor neurons of a rodent as disclosed herein exhibit increased oxidative stress compared to a motor of a wild-type rodent.

In one aspect, a rodent as described herein is a rat or a mouse. In some embodiments, the rodent is a mouse from a strain selected from the group consisting of a 129 strain, a C57BL/6 strain, and a mixed C57BL/6×129 strain.

Also provided herein is a tissue or cell, e.g., an embryonic stem cell, a motor neuron cell, etc., isolated or derived from a rodent described herein, e.g., which may be examined histologically and/or cultured. Also provided are the nucleic acids described herein.

Also provided are methods comprising culturing a cell or a population of cells isolated from a rodent described herein, which may result in, e.g., motor neurons useful for in vitro manipulation. In some embodiments, provided are methods of making a population of motor neurons that exhibit increased oxidative stress compared to control motor neuron cells, the method comprising establishing embryoid bodies derived from the rodent provided herein and differentiating the embryoid bodies into motor neurons. In some embodiments, embryoid bodies are developed from inner mass embryonic stem cells. In some embodiments, inner mass embryonic stem cells are isolated and cultured, e.g., in embryonic stem cell medium (ESM: DMEM+15% Fetal bovine serum+Penicillin/Streptomyocin+Glutamine+Non essential amino acids+nucleosides+β-mercaptoethanol+Sodium pyruvate+LIF) for 2 days, to form embryoid bodies. The embryoid bodies may be subsequently cultured in differentiation medium (Advanced DMEM/F12+Neurobasal medium+10% Knockout serum+Penicillin/Streptomyocin+Glutamine+β-mercaptoethanol) e.g., for 1-3 days, e.g., 2 days prior to further culture in retinoic acid and smoothened agonists, e.g., for 5 days. Differentiated motor neurons developed from inner mass embryonic stem cells isolated from a rodent provided herein may be matured, e.g., in Embryonic Stem cell-derived Motor Neuron medium (ESMN: Neurobasal medium+2% Horse serum+B27+Glutamine+Penicillin/Streptomyocin+β-mercaptoethanol+10 ng/ml GDNF, BDNF, CNTF) to form stable motor neuron cell lines that exhibit increased oxidative stress compared to motor neuron cells developed from rodents not comprising the modified DR6 allele and/or nucleic acid.

Also provided herein is a method for identifying a candidate agent for modulating motor neuron dysfunction, which may be useful for treating, preventing and/or inhibiting ALS comprising (a) administering the agent to a rodent disclosed herein; and (b) determining the effect of the candidate agent in the rodent compared to a test control rodent that has the same genomic structure but that did not receive the candidate agent, e.g., determining whether the agent prevents, inhibits, delays and/or reverses at least one of the ALS-like symptoms in the rodent compared to a control rodent; wherein the prevention, inhibition, delay and/or reversal of the at least one ALS-like symptom, e.g., a symptom of a motor neuron dysfunction such as kyphosis, abnormal hind limb clasping, deficient motor coordination, deficient motor learning ability, weight loss, and deficient sensory perception, in the rodent is indicative of a candidate agent that may be useful for treating motor neuron dysfunction, e.g., preventing and/or inhibiting ALS. The agent may be administered prior to, simultaneously to, or after the onset of ALS-like symptoms in the rodent, e.g., prior to, simultaneously to, or after the detection of at least one symptom of a motor neuron dysfunction by blinded subjective ALS-TDI neurological scoring, rotarod testing, catwalk testing, open field testing, measuring weight, or determining the latency to respond to a painful stimulus, e.g., at two or more different timepoints.

In some embodiments, the candidate agent modulates the at least one symptom of motor neuron dysfunction by at least 10%, e.g., at least 15%, e.g., at least 20%. In other embodiments, the presence of the candidate agent modulates the symptom the at least one symptom of motor neuron dysfunction, e.g., by at least 50%, e.g., by at least 75%, e.g., by at least 80%, e.g., by at least 95%, e.g., by at least 99%. In some embodiments, the candidate agent prevents the at least one symptom of motor neuron dysfunction. Candidate agents that modulate the at least one symptom by (1) preventing and/or inhibiting at least one of kyphosis and abnormal hind limb clasping and/or (2) preventing and/or restoring deficient motor coordination, deficient motor learning ability, weight loss, and/or deficient sensory perception may be useful for treating neurodenerative diseases, e.g., ALS.

Methods of determining whether the agent prevents, inhibits, delays and/or reverses at least one of the ALS-like symptoms in the rodent compared to control rodents may comprise examining tissue and/or a cell isolated from the rodent, e.g., analysis of the tissue and/or cell to understand the microanatomy, function and structure of the tissue and/or cell, e.g., by histochemistry; cell, tissue and/or organ culture, microscopic techniques and/or evaluation of expression of proteins, e.g., myelin binding protein (MBP), nerve growth factor receptor (NGFR), choline acetyltransferase (Chat), Mnx homeobox, glutamate [NMDA] receptor subunit 3B (Grin3b), and glutamate receptor 2(Gria2). In one aspect, the cell evaluated is a neuron, a glial cell, or a combination thereof. In another aspect, the tissue evaluated is the brain and/or spinal cord. Methods of determining whether the agent prevents, inhibits, delays and/or reverses at least one of the ALS-like symptoms in the rodent compared to control rodents may also include subjective ALS-TDI neurological scoring, rotarod testing, catwalk testing, open field testing, measuring weight, and/or determining the latency to respond to a painful stimulus.

In some embodiment, the at least one symptom tested is indicative of an upper motor neuron dysfunction, e.g., the at least one symptom is selected from the group consisting of tremors, spastic paralysis (rigidity), abnormal reflexes, and a combination thereof. In some embodiments, the at least one symptom tested is indicative of a lower motor neuron dysfunction, e.g., the at least one symptom is selected from the group consisting of muscle weakness and wasting, fasciculations, and a combination thereof. In some embodiment, the at least one symptom evaluated is reduced weight gain. In some embodiments, the at least one function tested is diminished nociception.

Also provided herein is a method for identifying a candidate agent for reducing oxidative stress in a motor neuron comprising: (a) culturing motor neurons derived from a non-human animal model as disclosed herein the presence or absence of an agent; (b) determining whether the agent prevents, inhibits, and/or reduces oxidative stress in the motor neurons as compared to control motor neurons cultured in the absence of the agent; wherein the prevention, inhibition, and/or reduction of oxidative stress in the motor neurons is indicative of a candidate agent for reducing oxidative stress in a motor neuron, e.g., and may be a candidate agent useful for treating, preventing and/or inhibiting ALS.

In some embodiments, the candidate agent reduces oxidative stress in a motor neuron by at least 10%, e.g., at least 15%, e.g., at least 20%. In other embodiments, the presence of the candidate agent inhibits oxidative stress by the motor neuron, e.g., by at least 50%, e.g., by at least 75%, e.g., by at least 80%, e.g., by at least 95%, e.g., by at least 99%. In some embodiments, the candidate agent prevents oxidative stress in the motor neurons, e.g., the level of oxidative stress is similar to that of wildtype motor neurons.

Also provided herein is a targeting vector comprising (a) a 5' targeting arm and a 3' targeting arm, wherein the 5' and 3' targeting arms direct the vector for insertion in an endogenous DR6 locus downstream of the endogenous DR6 signal peptide sequence, (b) a selection cassette, and optionally (c) a transmembrane domain encoding sequence. In one embodiment, the transmembrane domain encoding sequence encodes an ROR1 transmembrane domain. In another embodiment, the transmembrane domain encoding sequence is operably linked to a reporter gene. In one embodiment, the selection cassette comprises a reporter gene, a drug resistance gene, or a combination thereof. In another embodiment, the selection cassette comprises a drug resistance gene. In some embodiments, the selection cassette comprises a neomycin phosphotransferase gene. In some embodiments, a targeting vector as provided herein comprises a sequence set forth as SEQ ID NO:16. In some embodiments, the targeting vector does not comprise a selection cassette. In some embodiments, a targeting vector as provided herein comprises a sequence set forth as SEQ ID NO:5.

Also provided herein are rodent cells comprising a targeting vector as described herein, such as an embryonic stem cell, e.g., a murine embryonic stem cell, e.g., a C57BL/6NTac embryonic stem cell.

BRIEF DESCRIPTION OF THE DRAWINGS

As shown in FIG. 1, the ZEN-Ub1 targeting vector (SEQ ID NO:5) comprises (from 5' to 3') a 5' homology arm (5' arm; SEQ ID NO:1), an ROR1 transmembrane domain encoding sequence (TM; SEQ ID NO:7) operably linked to an *E. coli* LacZ reporter gene (LacZ; SEQ ID NO:8), which is operably linked to a polyadenylation signal (pA; SEQ ID NO:9). The Zen-Ub1 cassette also comprises a selection cassette comprising a promotor from the human ubiquitin C gene (hUB; SEQ ID NO:11) operably linked to a neomycin phosphotransferase resistance gene (Neo; SEQ ID NO:12) operably linked to a polyA signal (pA; SEQ ID NO:13), the selection cassette being flanked by identical loxP nucleic acid sequences (SEQ ID NO:10). The 3' homology arm of the Zen-UB1 cassette (3' arm) is set forth as SEQ ID NO:4. Upon homologous recombination, the resulting allele comprises a nucleic acid sequence encoding the endogenous DR6 signal sequence operably linked to the ROR1 transmembrane domain encoding sequence and the LacZ reporter gene, the nucleic acid sequence being set forth as SEQ ID NO:17, and lacks the entire endogenous genomic sequence starting from base 4103 in exon 2 to the stop codon of exon 6, e.g., lacks a nucleotide sequence encoding an endogenous cytoplasmic domain, transmembrane domain and extracellular domain.

FIG. 2A shows the mean motor impairment scores (y-axis) of wild-type (-●-) and DR6$^{-/-}$ mice (-■-) at different timepoints (x-axis), while FIG. 2B shows the mean motor impairment scores of male (-▲-) and female (--●--) DR6$^{-/-}$ mice at different timepoints (x-axis). FIG. 2C shows the mean rigidity scores (y-axis) of wild-type (-●-) and DR6$^{-/-}$ mice (-■-) mice at different timepoints (x-axis), while FIG. 2D shows the mean rigidity scores of male (-▲-) and female (--●--) DR6$^{-/-}$ mice at different timepoints (x-axis). FIG. 2E shows the mean tremor scores (y-axis) of wild-type (-●-) and DR6$^{-/-}$ mice (-■-) mice at different timepoints (x-axis) while FIG. 2F shows the mean tremor scores of male (-▲-) and female (--●--) DR6$^{-/-}$ mice at different timepoints (x-axis). FIG. 2G shows the mean motor impairment scores (y-axis) of wild-type (-●-) and DR6$^{-/-}$ mice (-■-) between 9 to 21 weeks of age (x-axis). FIG. 2H shows the mean rigidity scores (y-axis) of wild type (-●-) and DR6$^{-/-}$ mice (-■-) mice between 9 to 21 weeks of age (x-axis). FIG. 2I shows the mean tremor scores of wild-type (-●-) and DR6$^{-/-}$ mice (-■-) between 9 to 21 weeks (x-axis). For experiment 1 (FIGS. 2A-2F), n=12 for wild-type mice and n=16 for DR6$^{-/-}$ mice (n=8 for male DR6$^{-/-}$ mice; n=8 for female DR6$^{-/-}$ mice), and at each time point, wild-type animals scored a 0 for each test. For experiment 2 (FIGS. 2G-2I), n=14 for wildtype mice and n=18 for DR6$^{-/-}$ mice. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.

FIG. 3A: The left and right panels show the body weight (y-axis; grams) of wild-type (tnsfr21$^{+/+}$) and DR6$^{-/-}$ (tnsfr21$^{-/-}$) mice on May 29, 2014 and Jun. 11, 2014, respectively. FIG. 3B: The left and right panels respectively show the maximum and median latency to fall off a rotarod (y-axis; seconds) for wild-type (tnsfr21$^{+/+}$; striped bars) and DR6-/- (tnsfr21$^{-/-}$; solid bars) mice. FIG. 3C: Shown are total immobility (y-axis), basic movements (y-axis), and fine motor movements of wild-type (tnsfr21$^{+/+}$; striped bars) and DR6$^{-/-}$ (tnsfr21$^{-/-}$; solid bars) mice across 60 minutes. FIG. 3D: X+Y Ambulations (y-axis) across one hour is shown for wild-type (tnsfr21$^{+/+}$; striped bars) and DR6$^{-/-}$ (tnsfr21$^{-/-}$; solid bars) mice. FIG. 3E: The left and right panels respectively show the sum of rearings (y-axis) and total rearing time (y-axis; seconds) of wild-type (tnsfr21$^{+/+}$; striped bars) and DR6-/- (tnsfr21$^{-/-}$; solid bars). FIG. 3F: The left and right panels respectively show the total distance traveled and total rest time (y-axis; sum of 60 minutes) of wild-type (tnsfr21$^{+/+}$; striped bar) and DR6$^{-/-}$ (tnsfr21$^{-/-}$; solid bar). * (p<0.05) denotes statistically significant differences between the two groups.

FIG. 7A provides the mean front and hind paw pressures. FIG. 7B provides mean front and hind paw print areas. FIG. 7C provides the mean front and hind stride lengths. FIG. 7D provides the mean front and hind stance phases. FIG. 7E provides mean front and hind swing speeds. FIG. 7F provides mean front and hind swing phases. FIG. 7G provides mean front and hind duty cycles. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.

DESCRIPTION

Figure 1:
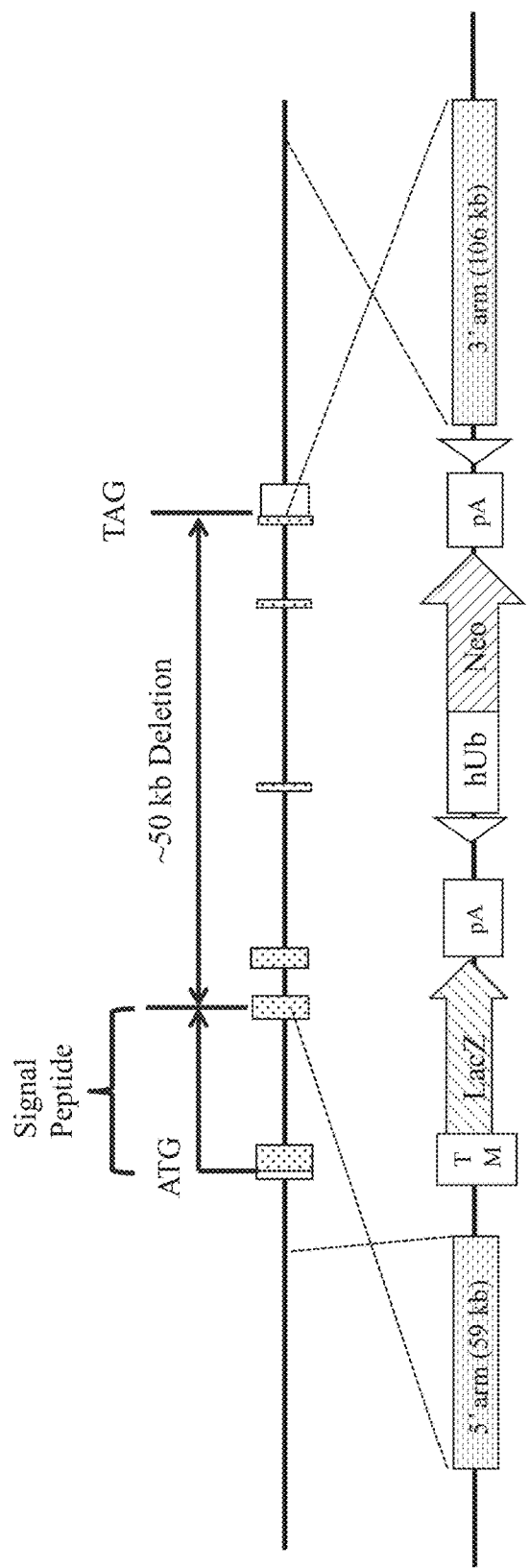
FIG. 1 illustrates a strategy for targeted disruption of the DR6 locus. The wild-type mouse DR6 locus is illustrated (not to scale) as the top line, which shows from 5' to 3' a 5' UTR (white box), the start codon (ATG), exons 1-6 (dotted boxes), a stop codon (TAG), and the 3' UTR. As shown, the endogenous mouse signal sequence is encoded by exon 1 and part of exon 2 (~4103 bases from the start codon), and the nucleic acid sequence encoding the signal peptide remains after recombination with a Zen-Ub1 cassette, which is depicted (not to scale) as the bottom line.
Figure 2A:
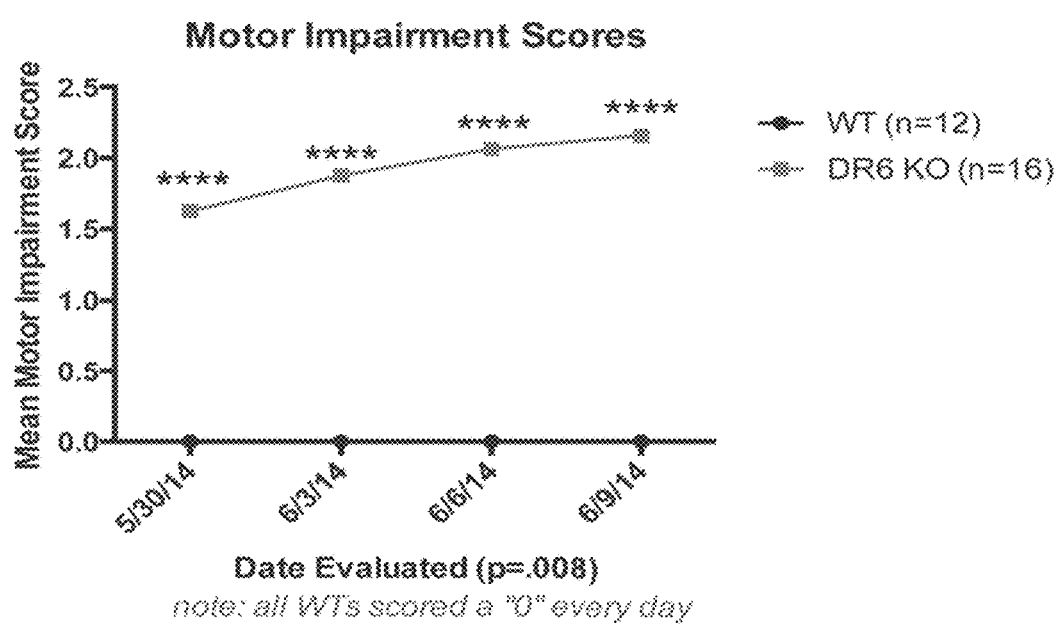
FIGS. 2A-2I show amyotrophic lateral sclerosis (ALS)-like motor impairment in DR6$^{-/-}$ mice that progresses rapidly over time independent of sex.
Figure 2B:
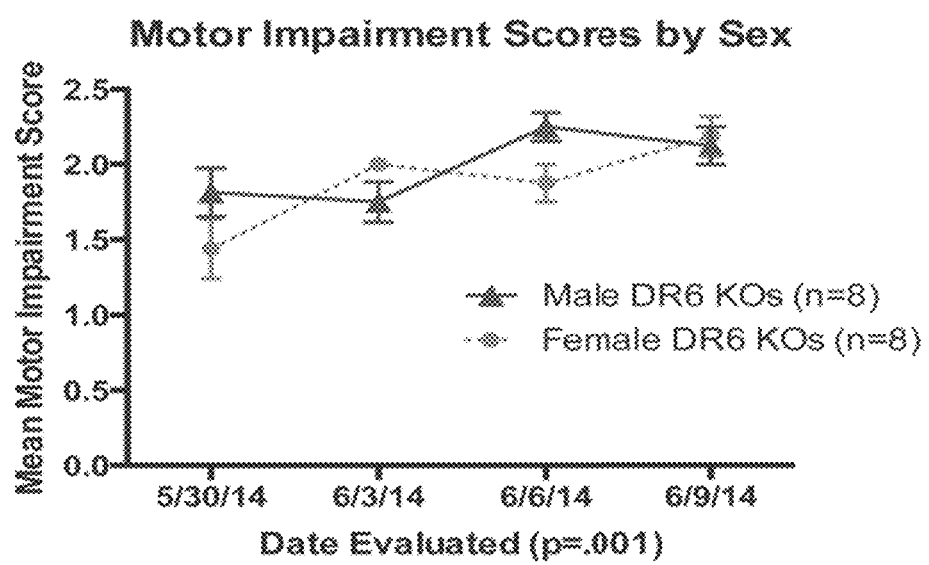
Figure 2C:
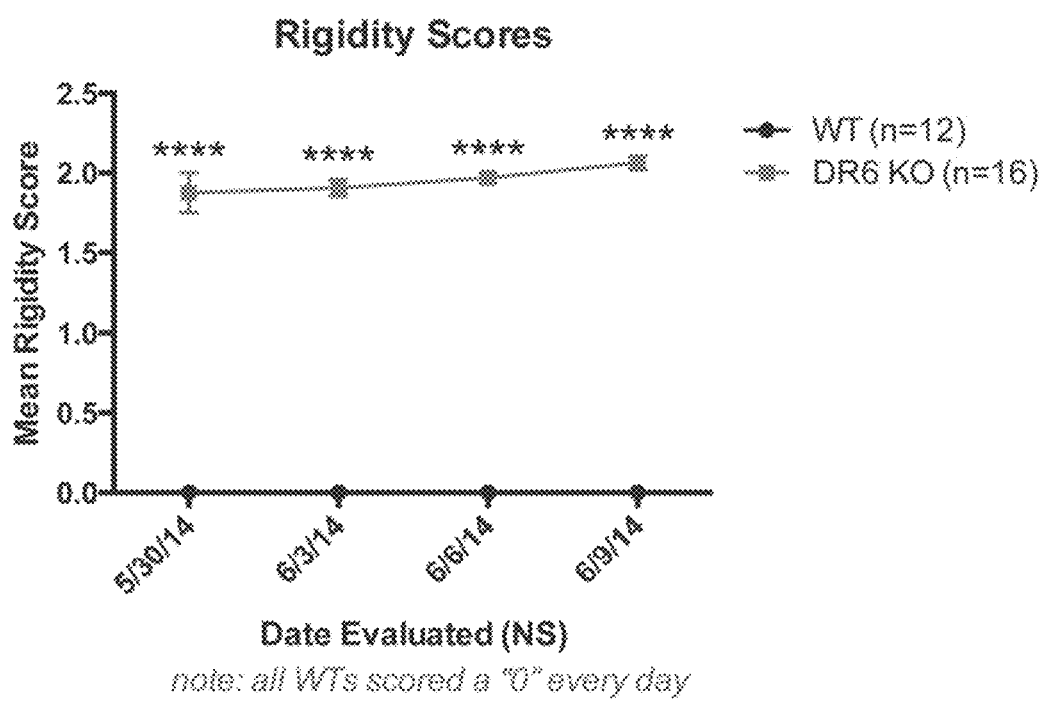
Figure 2D:
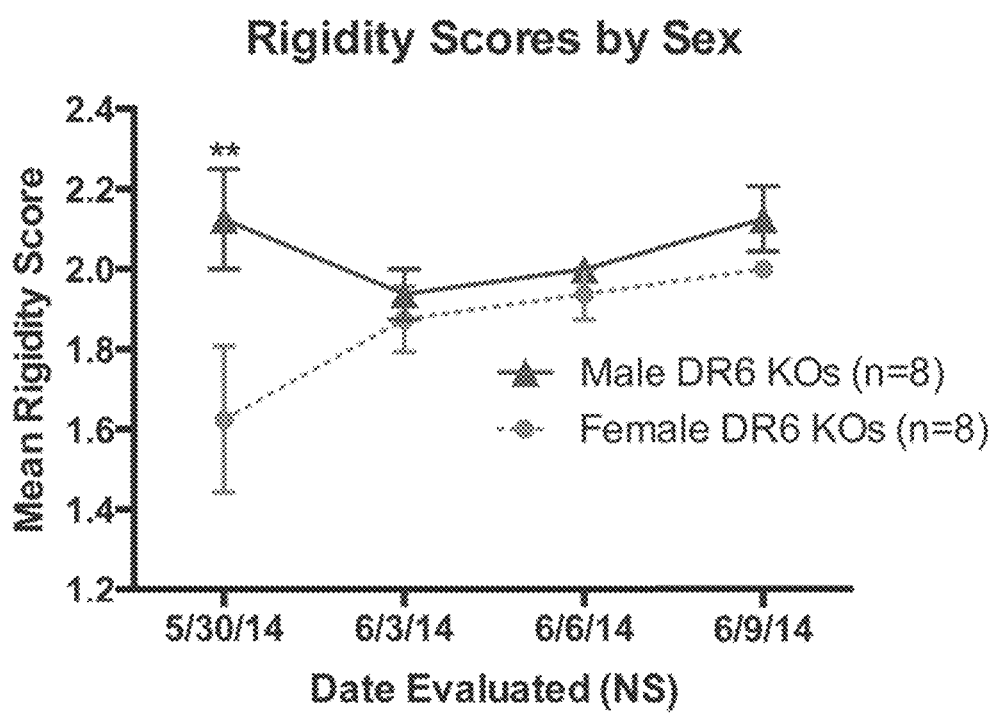
Figure 2E:
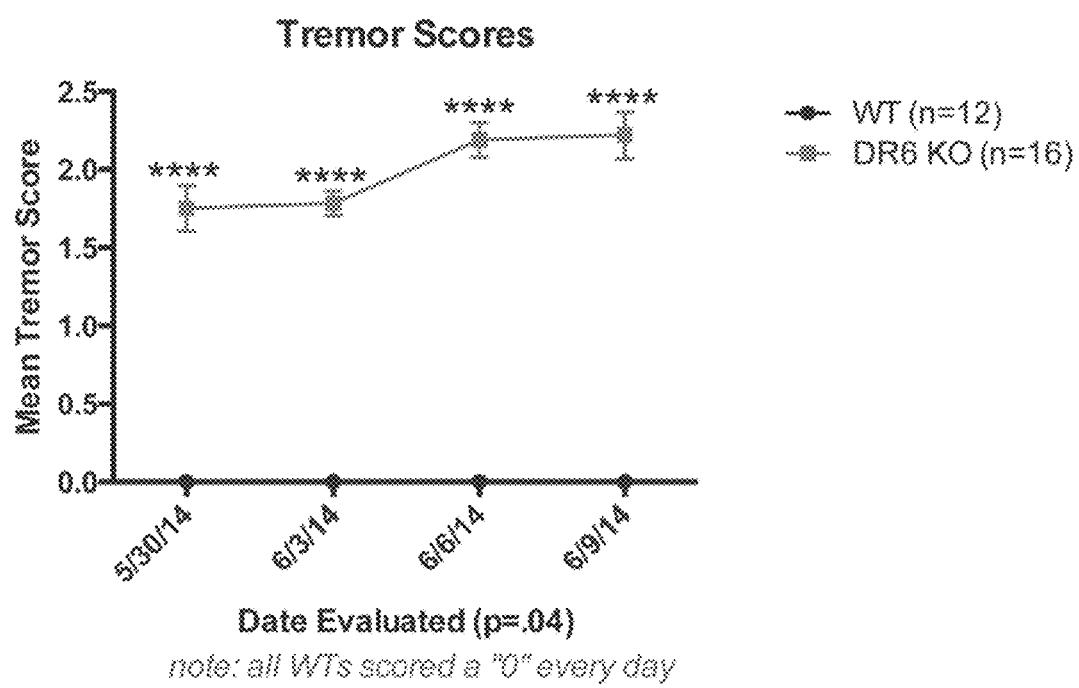
Figure 2F:
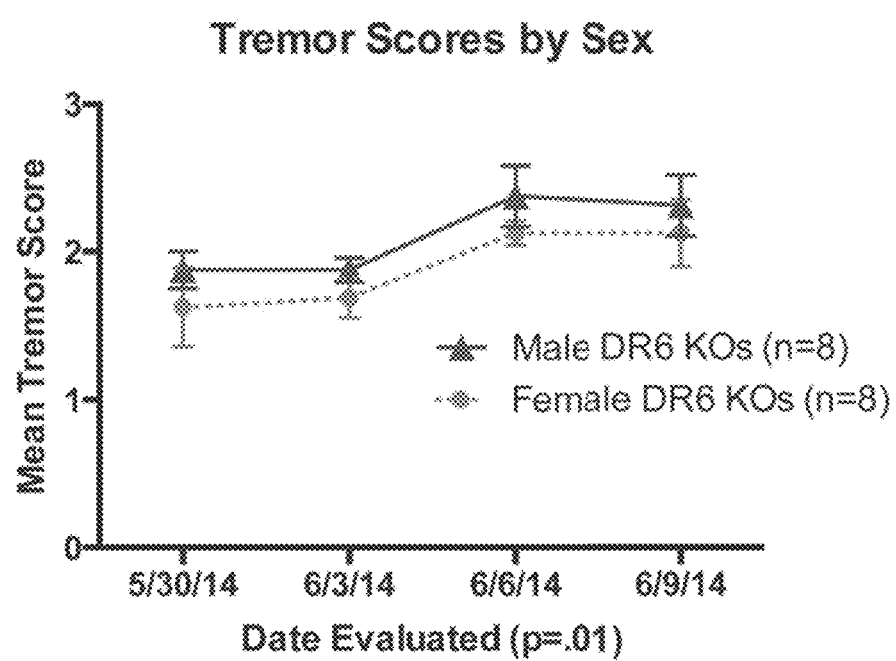
Figure 2G:
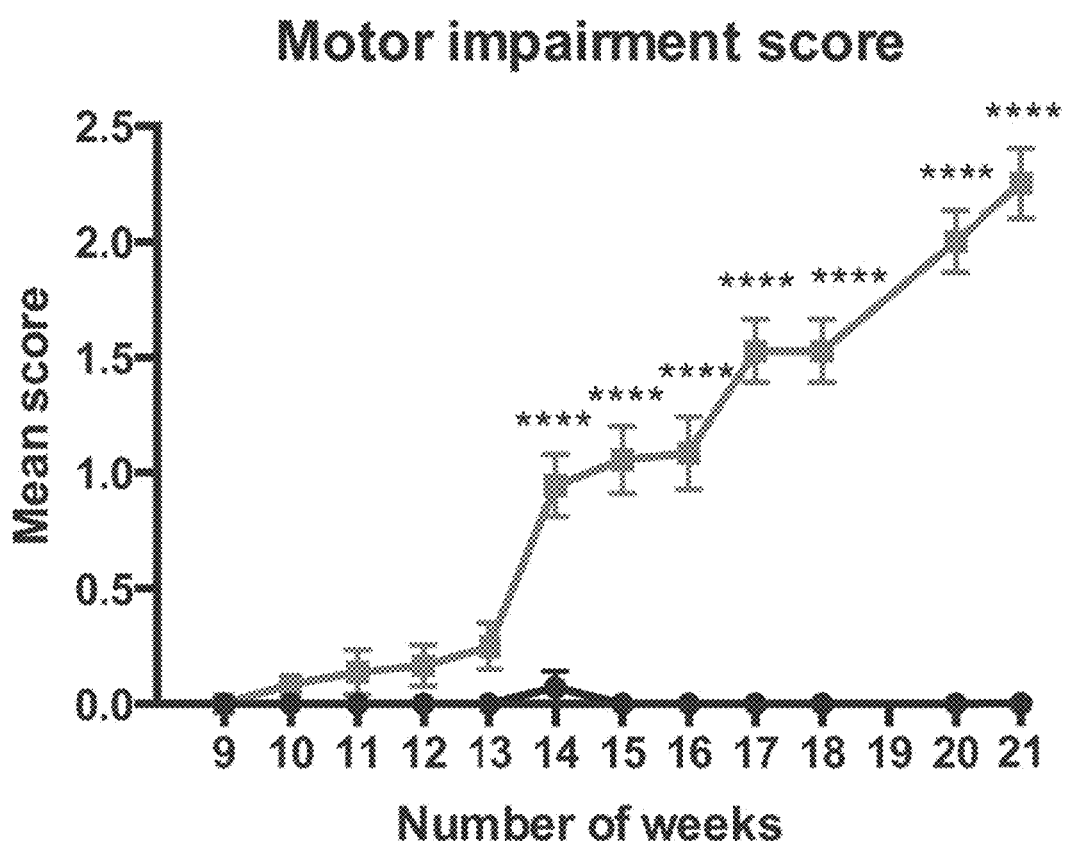
Figure 2H:
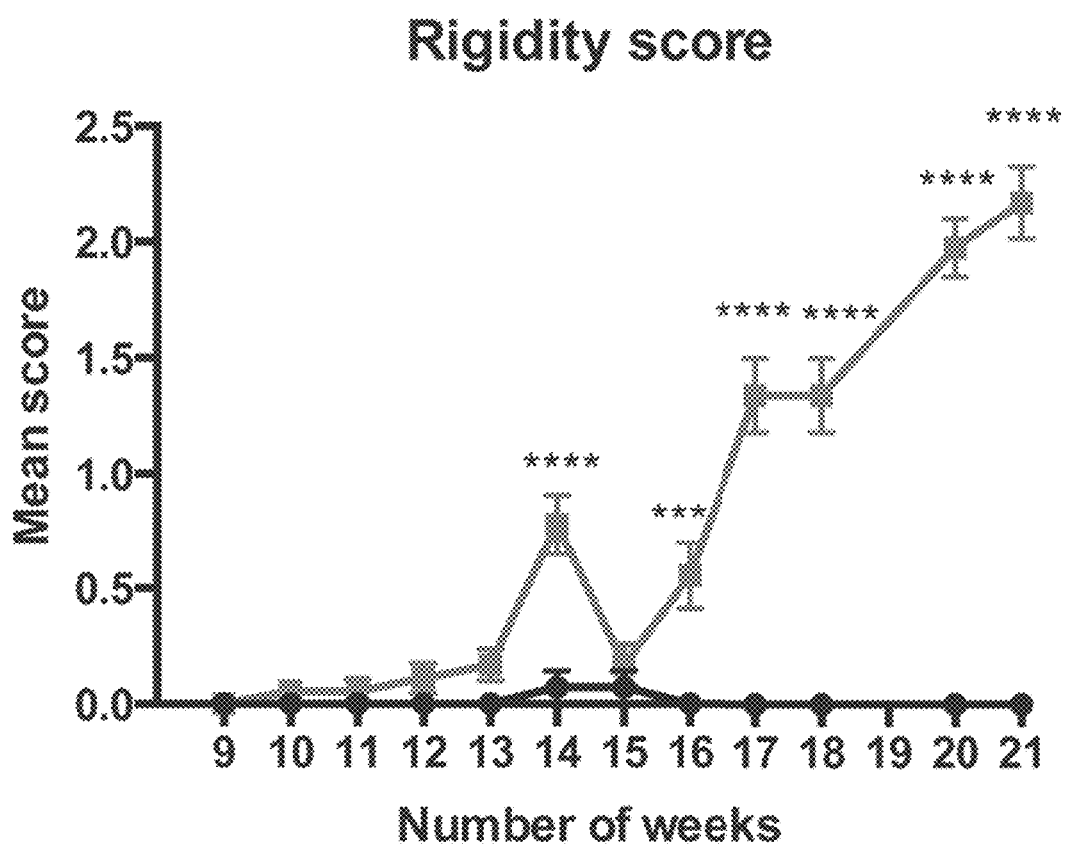
Figure 2I:
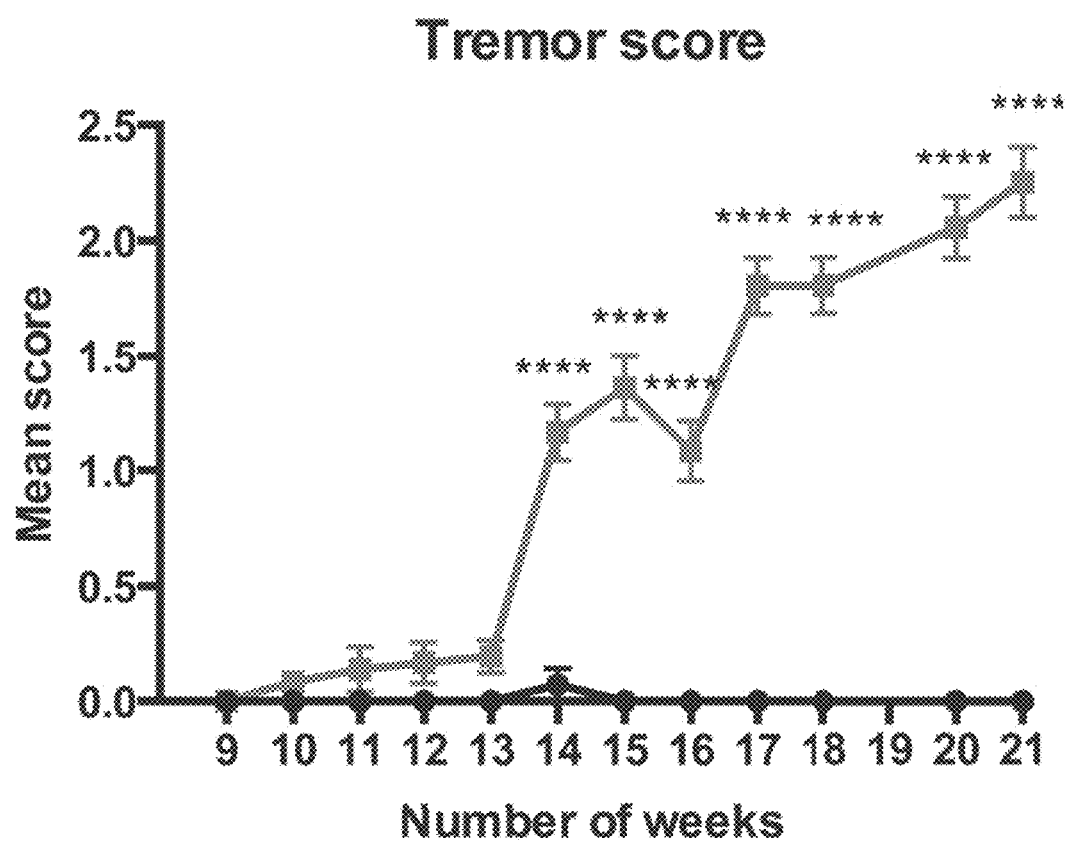
Figure 3A:
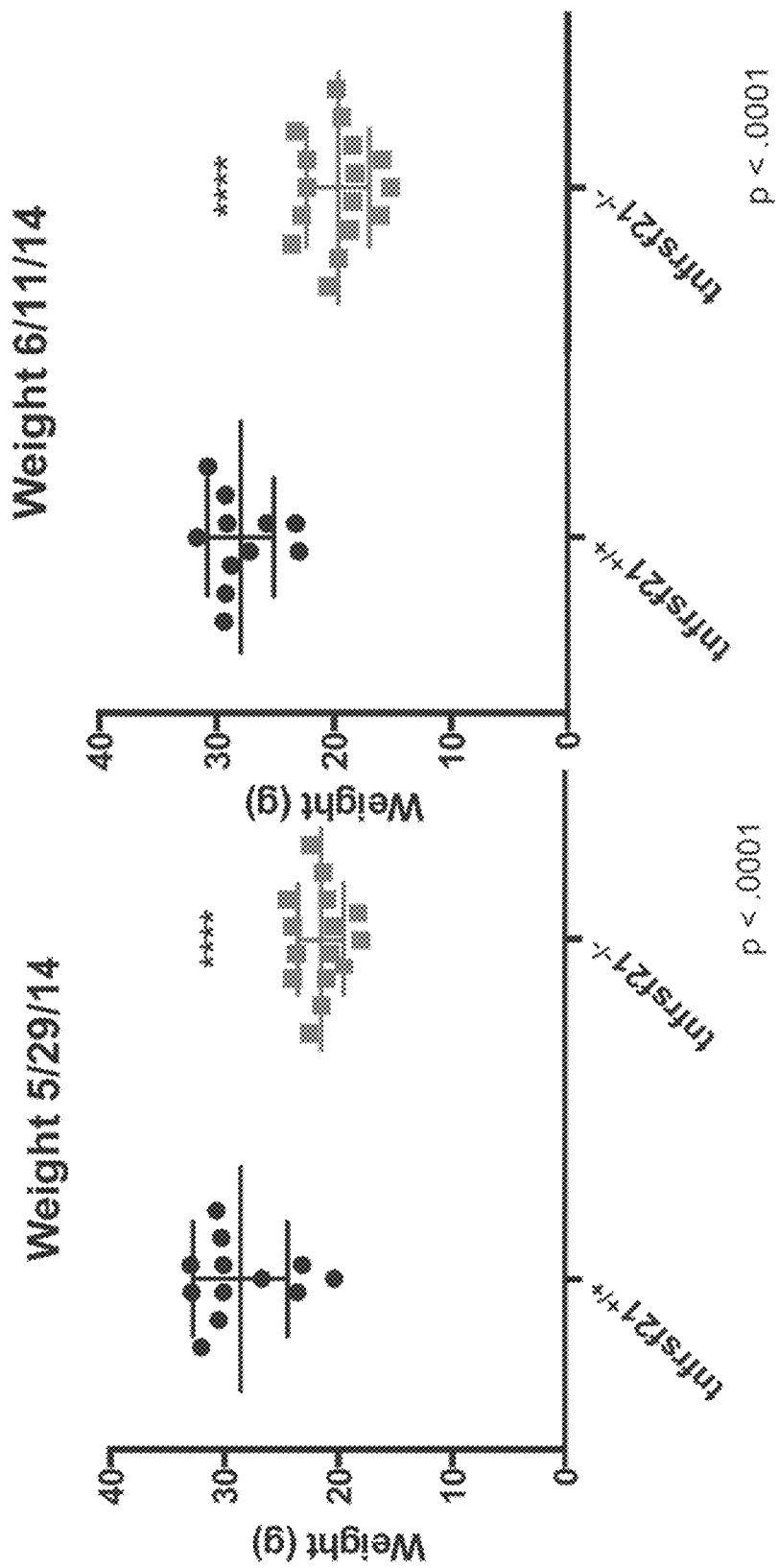
FIGS. 3A-3F show ALS-like phenotypes of DR6$^{-/-}$ mice presenting as decreased weight and significant motor abnormalities.
Figure 3B:
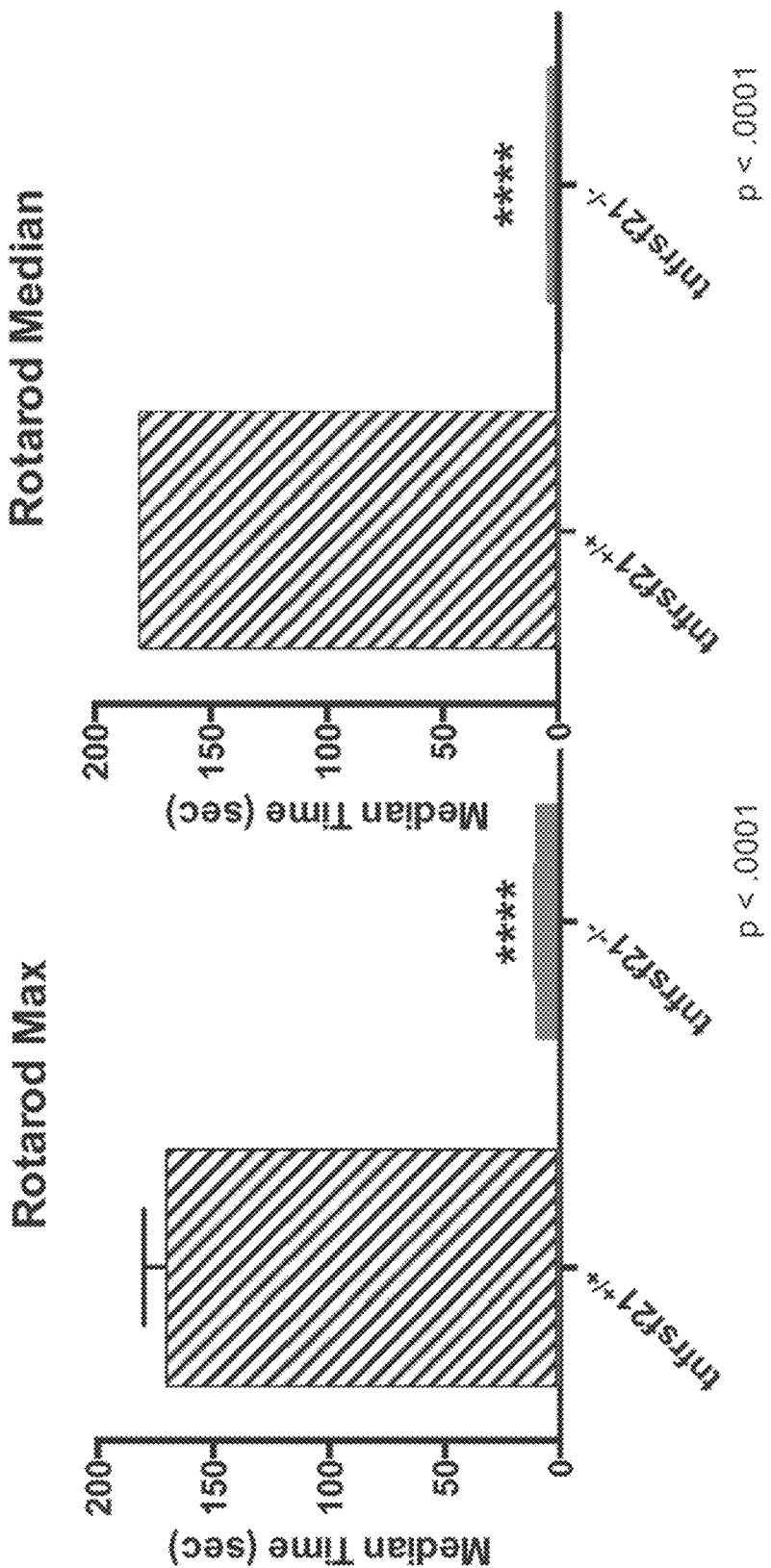
Figure 3C:
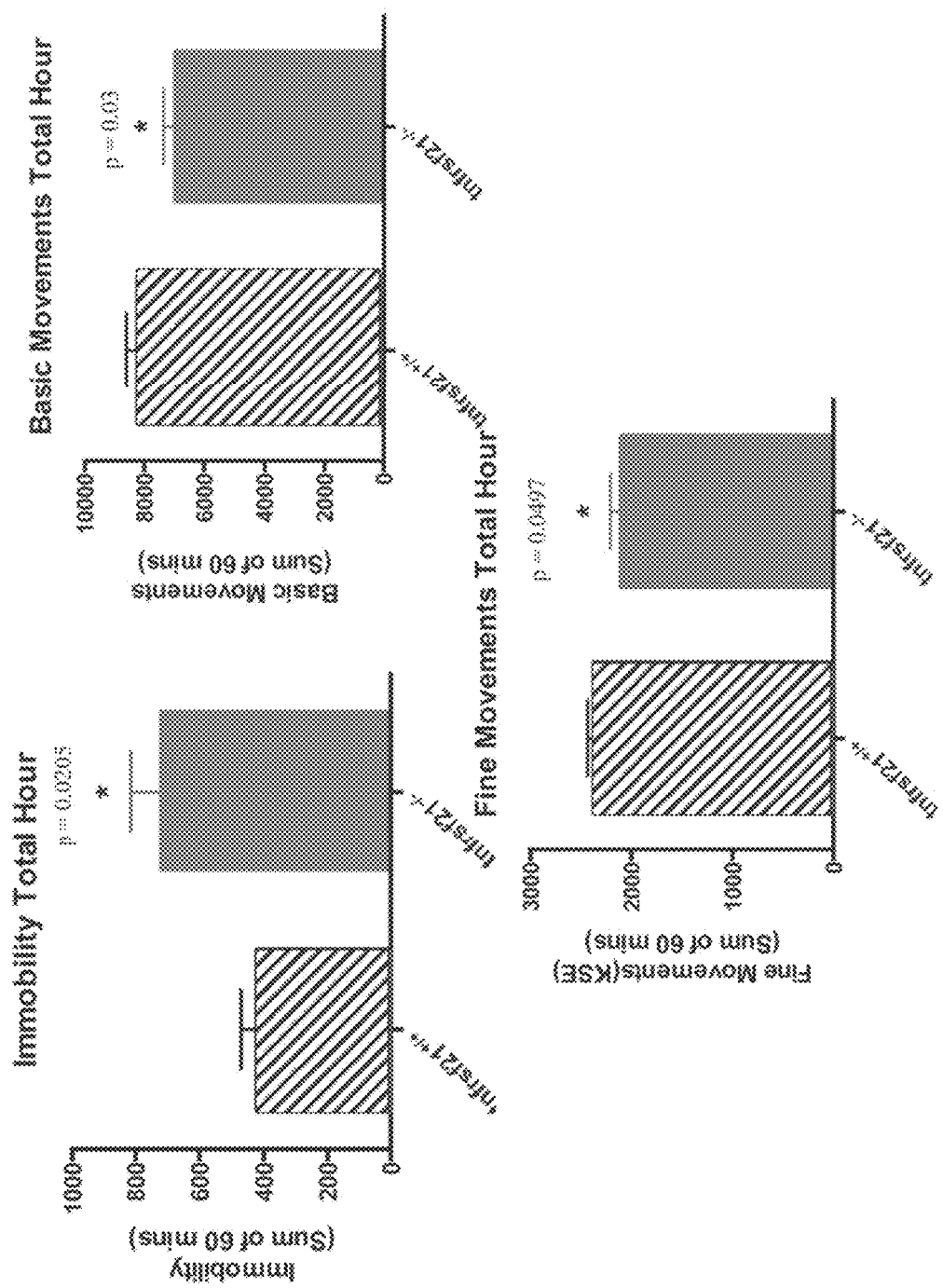
Figure 3D:
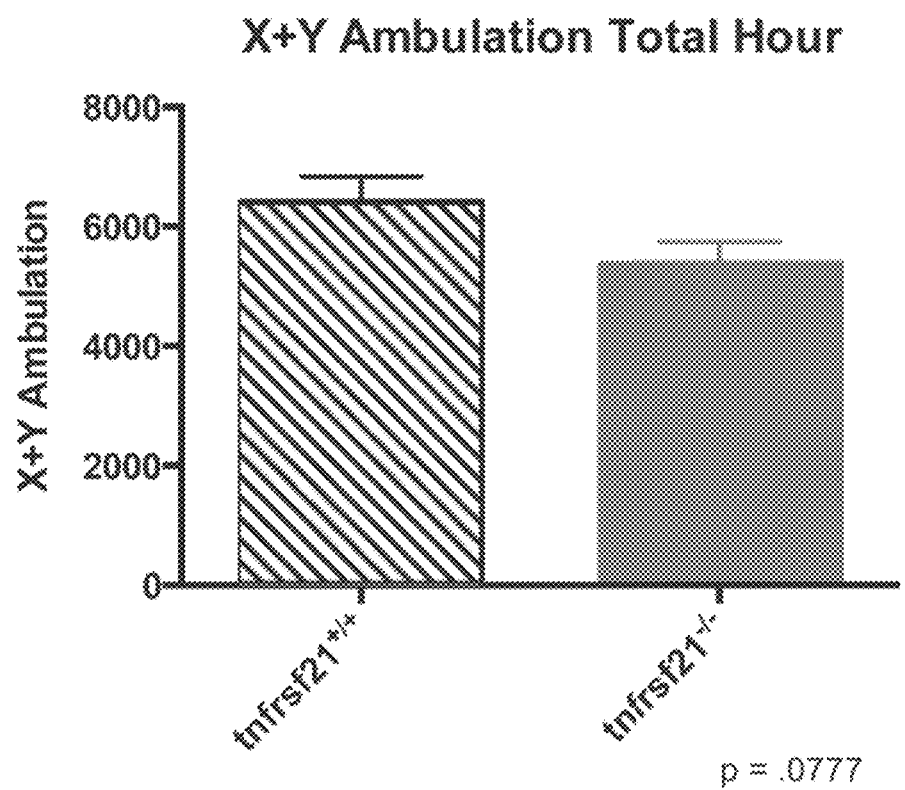
Figure 3E:
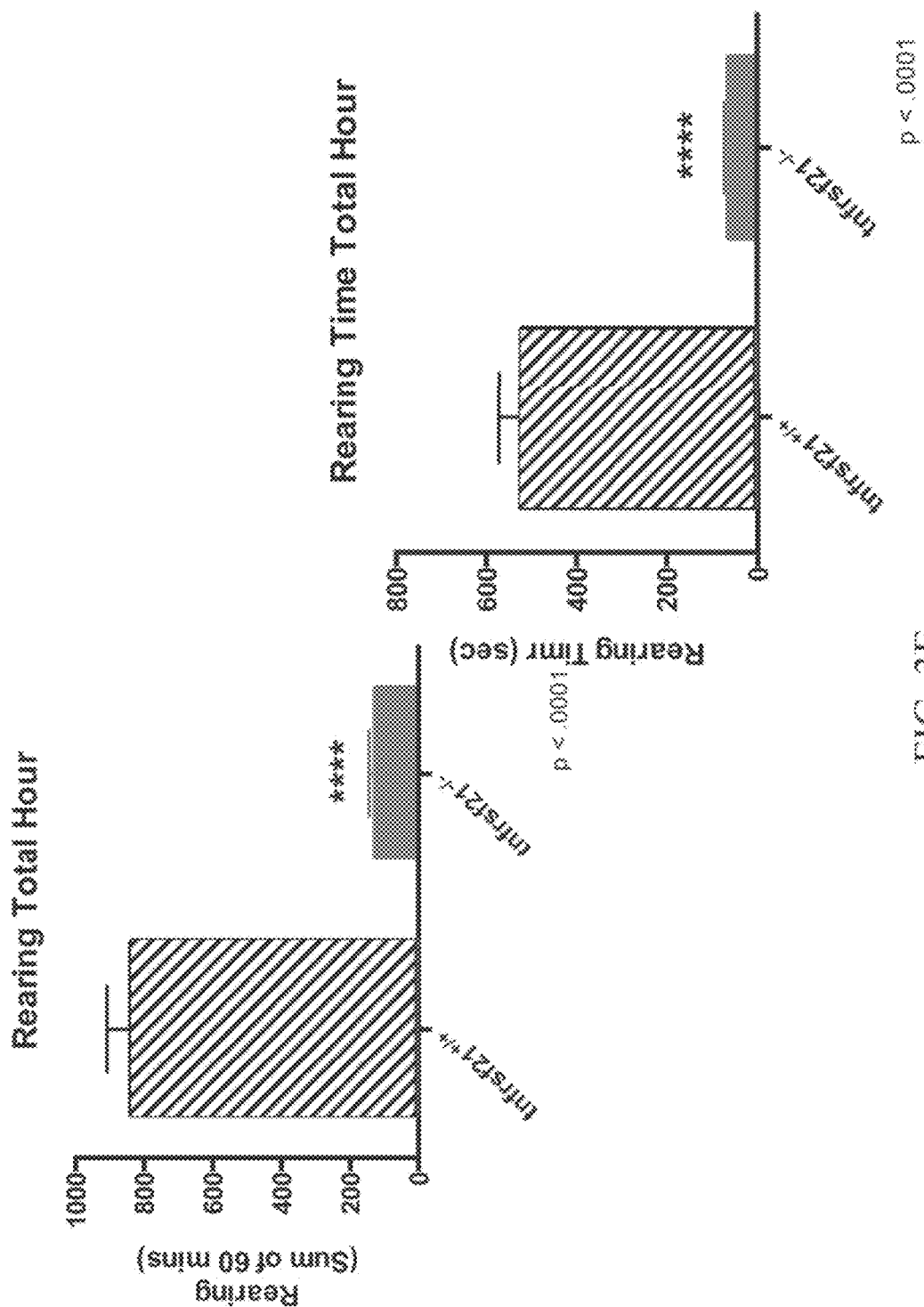
Figure 3F:
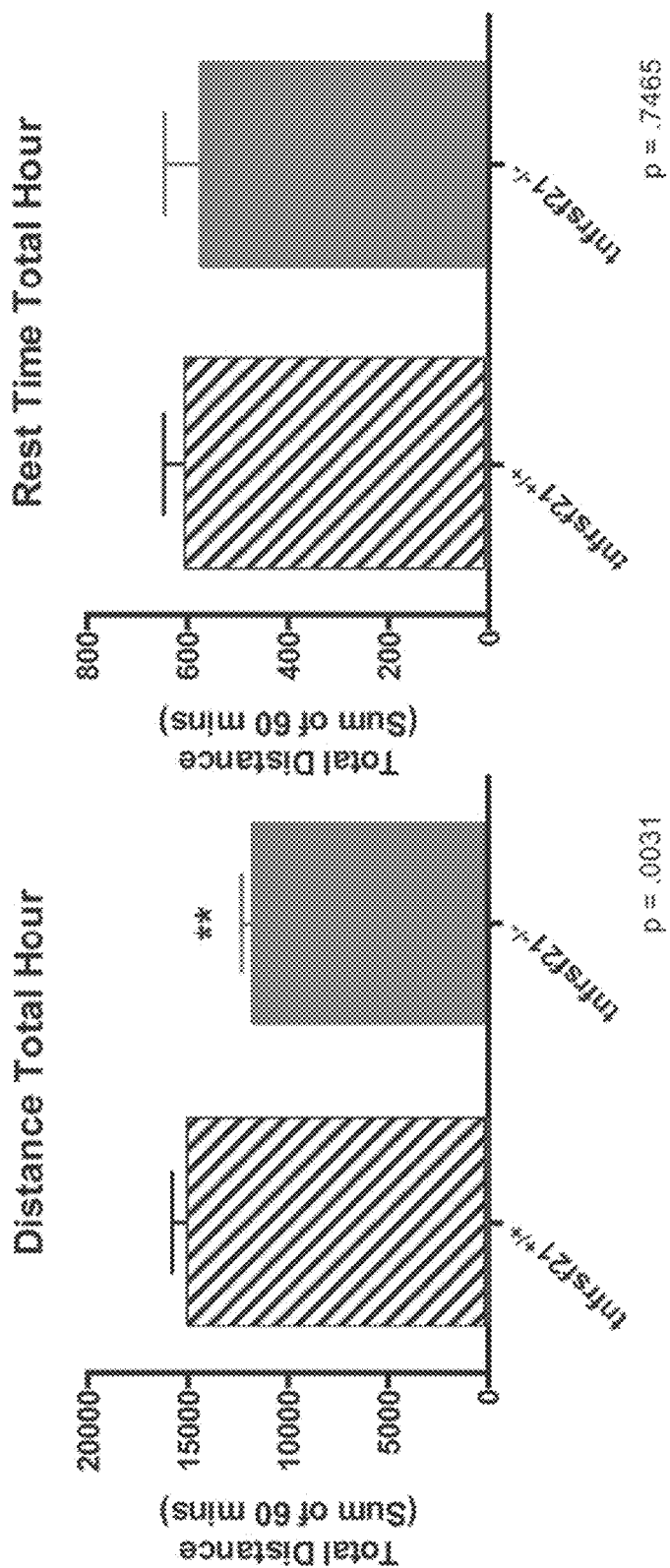
Figure 4A:
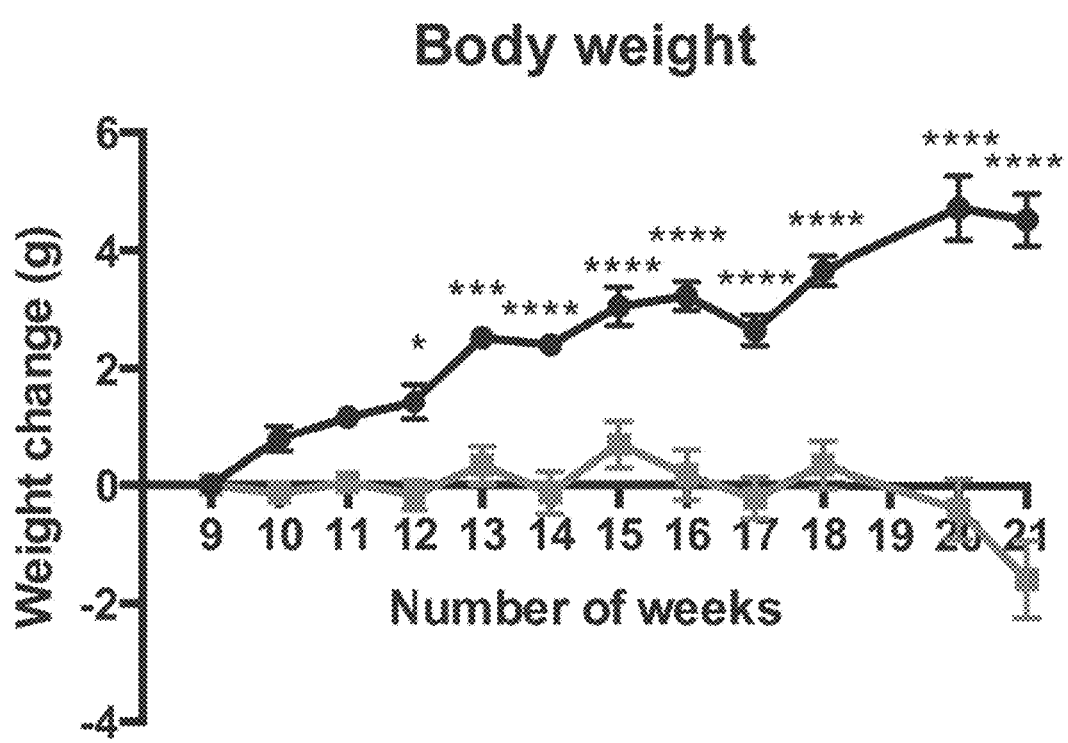
FIGS. 4A-C show the (A) mean body weight (y-axis; weight in grams) (B) median latency to fall off a rotarod (y-axis; seconds) and (C) maximum time to fall off a rotarod (y-axis; second) of wild-type (-●-; n=14) and DR6$^{-/-}$ (-■-; n=18) mice (x-axis) at 9 to 21 weeks of age. The maximum time spent on the rotarod was 180 seconds. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.
Figure 4B:
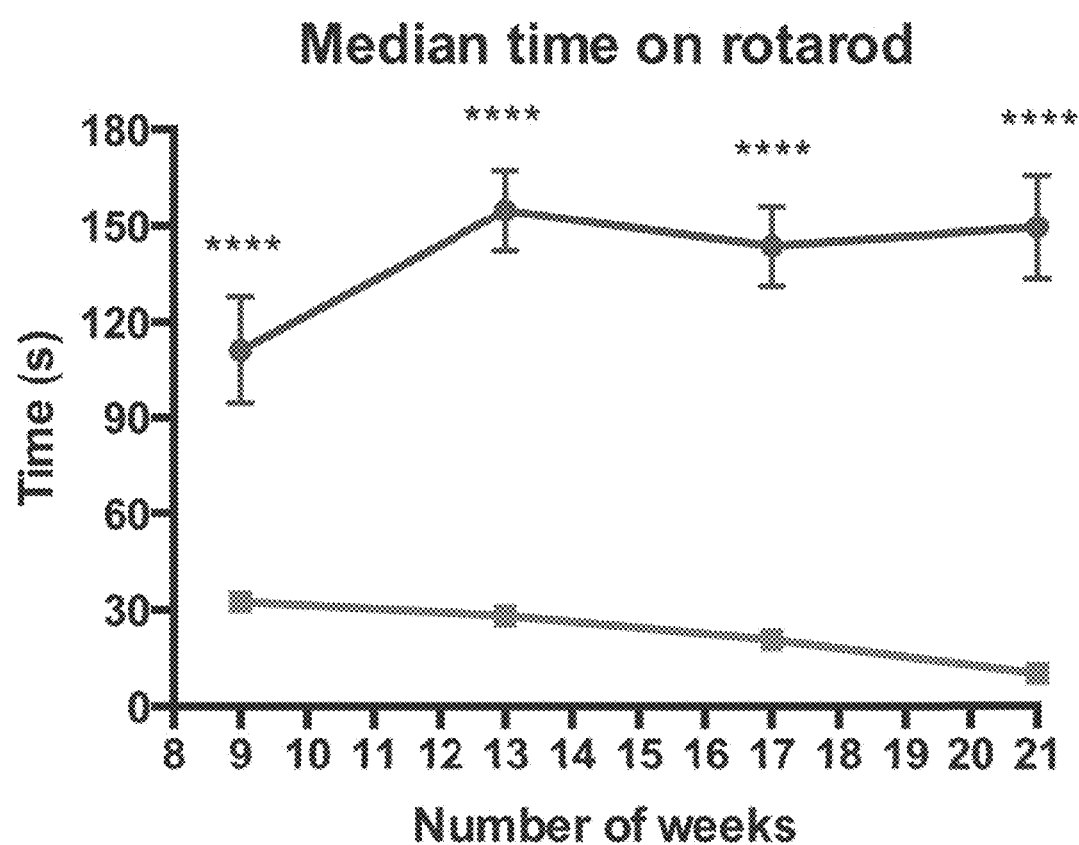
Figure 4C:
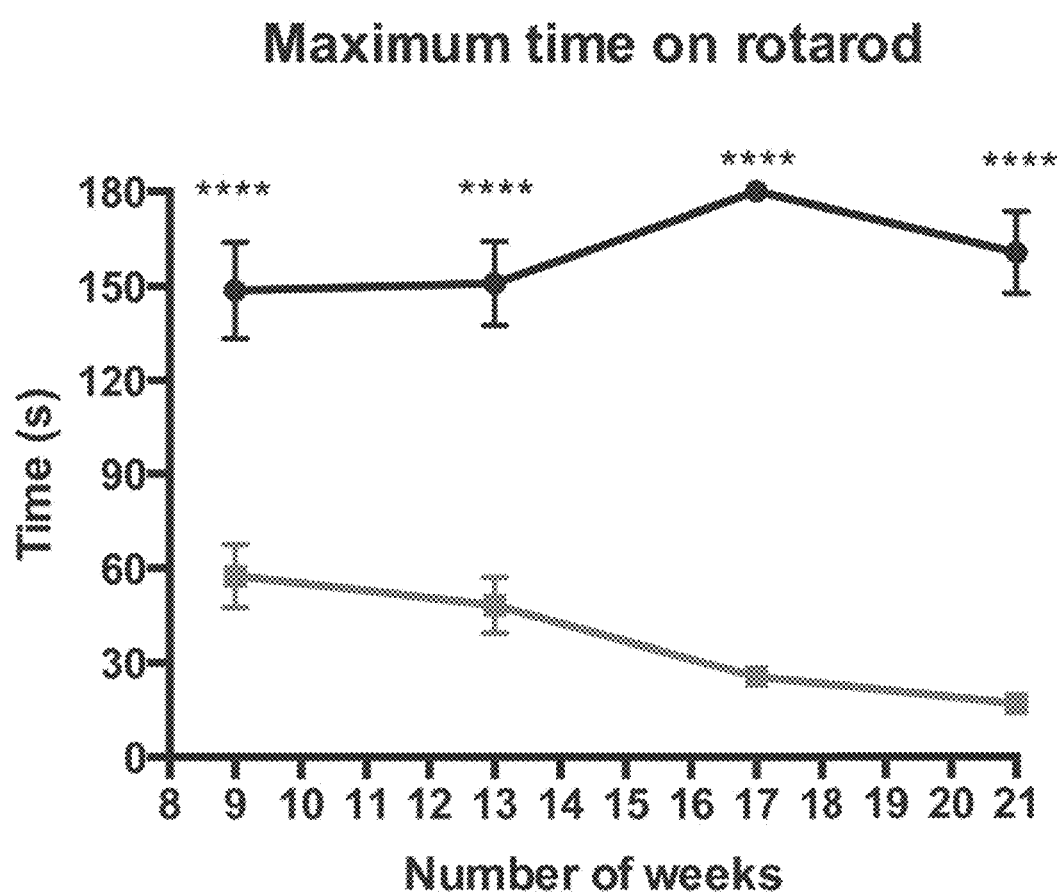
Figure 5A:
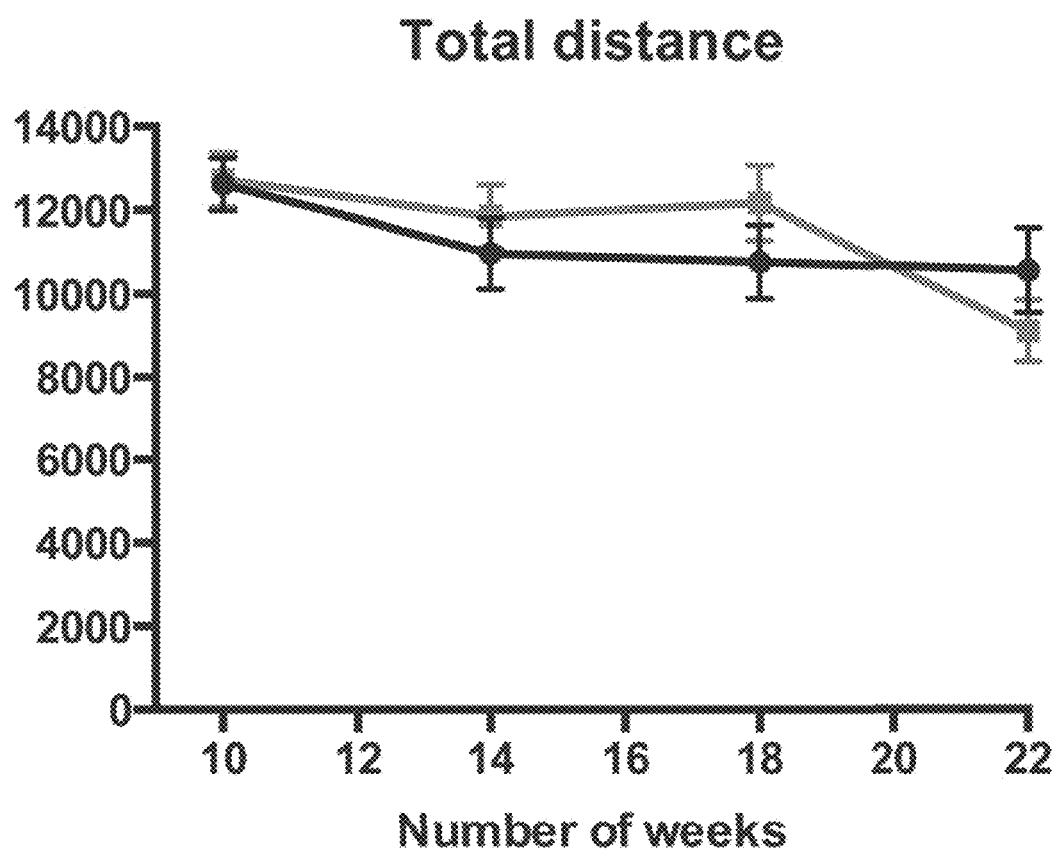
FIGS. 5A-H show the open field locomotor behavior of wildtype and DR6$^{-/-}$ mice, e.g., the total distance (FIG. 5A), immobility (FIG. 5B), total rearing time (FIG. 5C), basic movements (FIG. 5D), fine movements (FIG. 5E), X+Y ambulation (FIG. 5F), total rest (FIG. 5G), and rearing (FIG. 5H) over an hour an hour of wild-type (-●-); n=14) and DR6$^{-/-}$ (knockout; -■-; n=16) animals between 10-21 weeks of age. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.
Figure 5B:
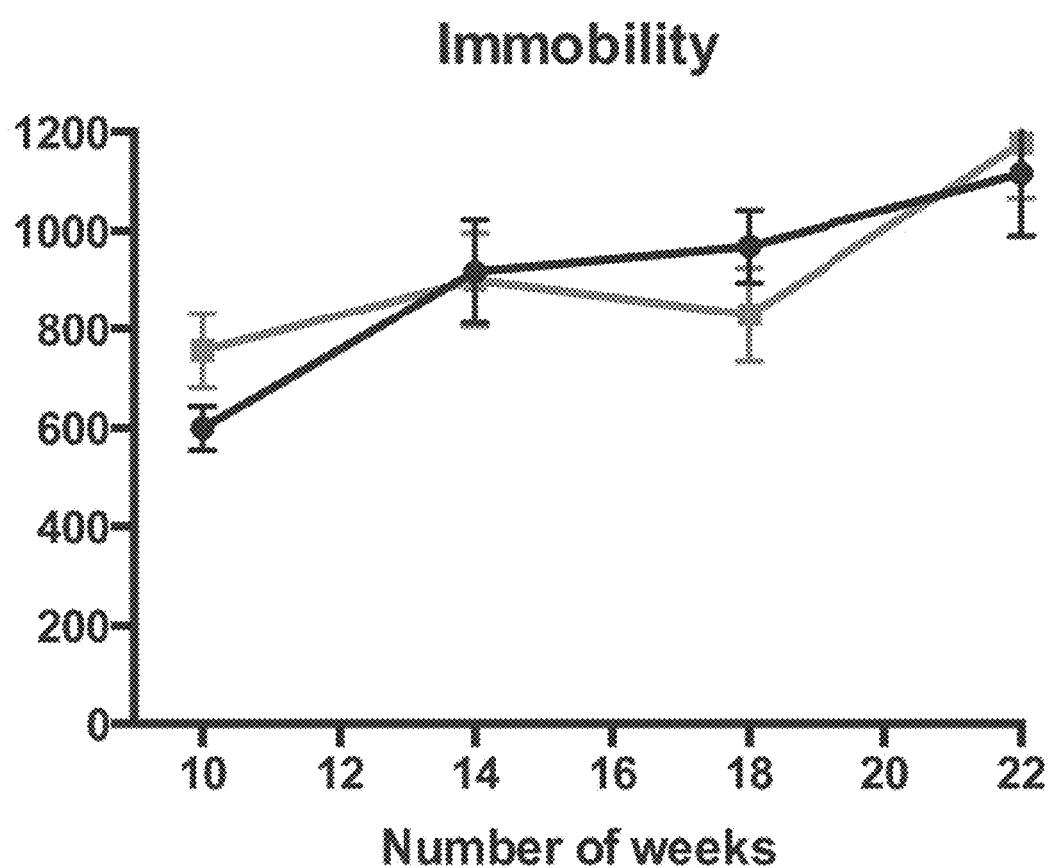
Figure 5C:
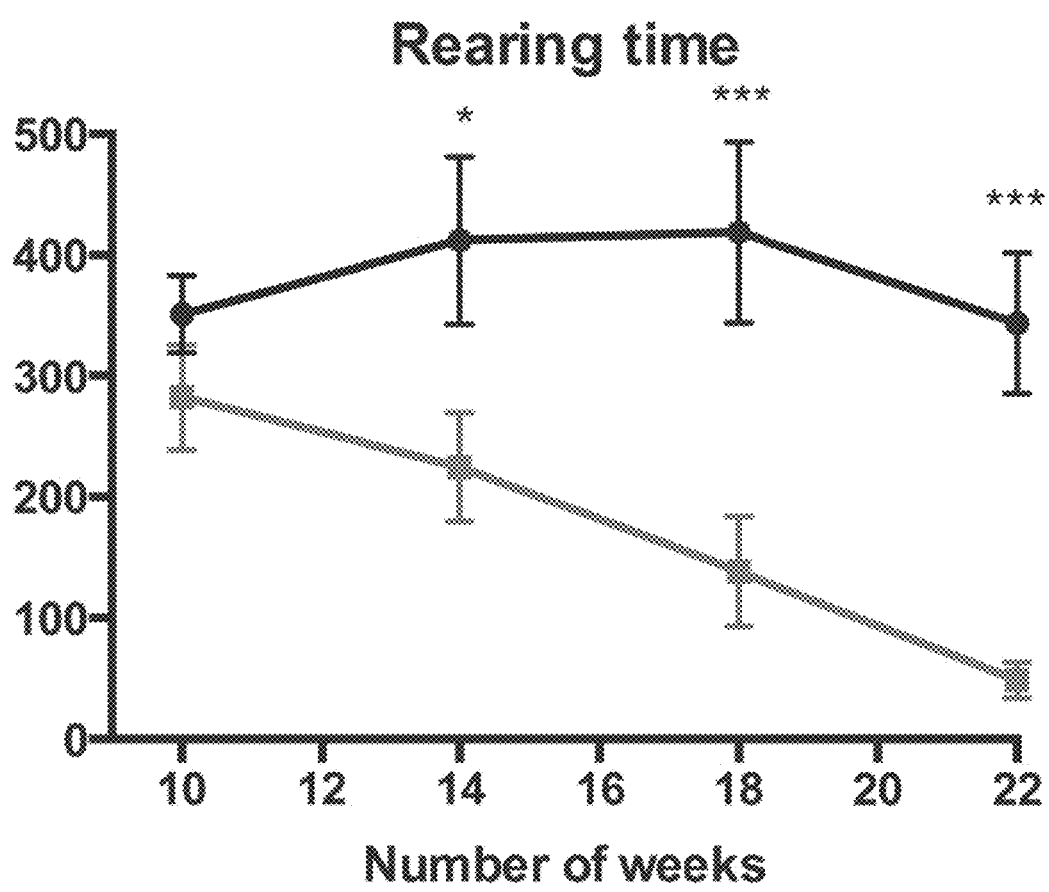
Figure 5D:
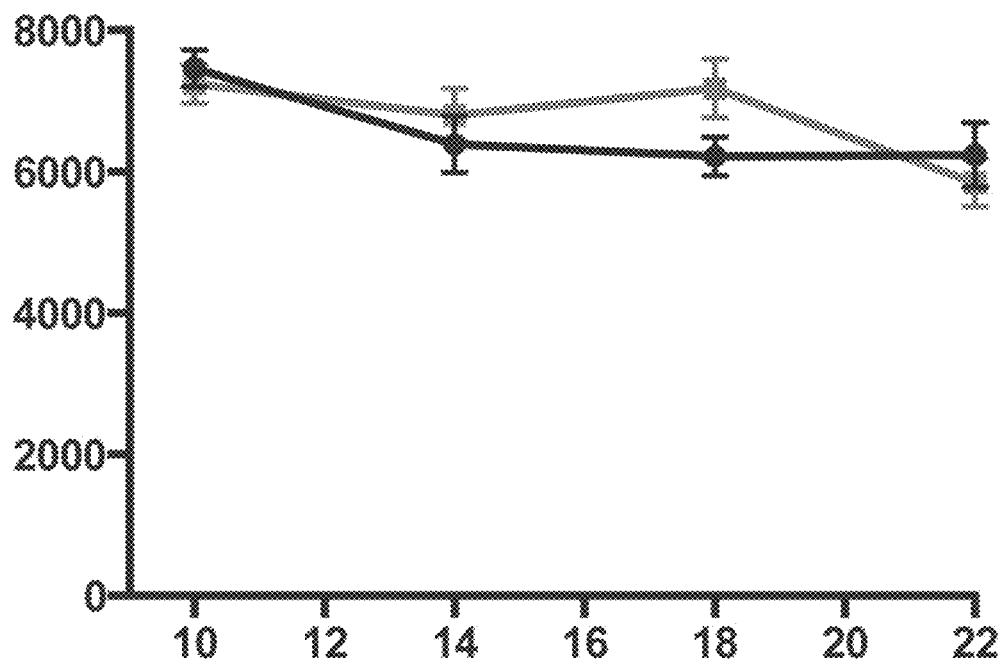
Figure 5E:
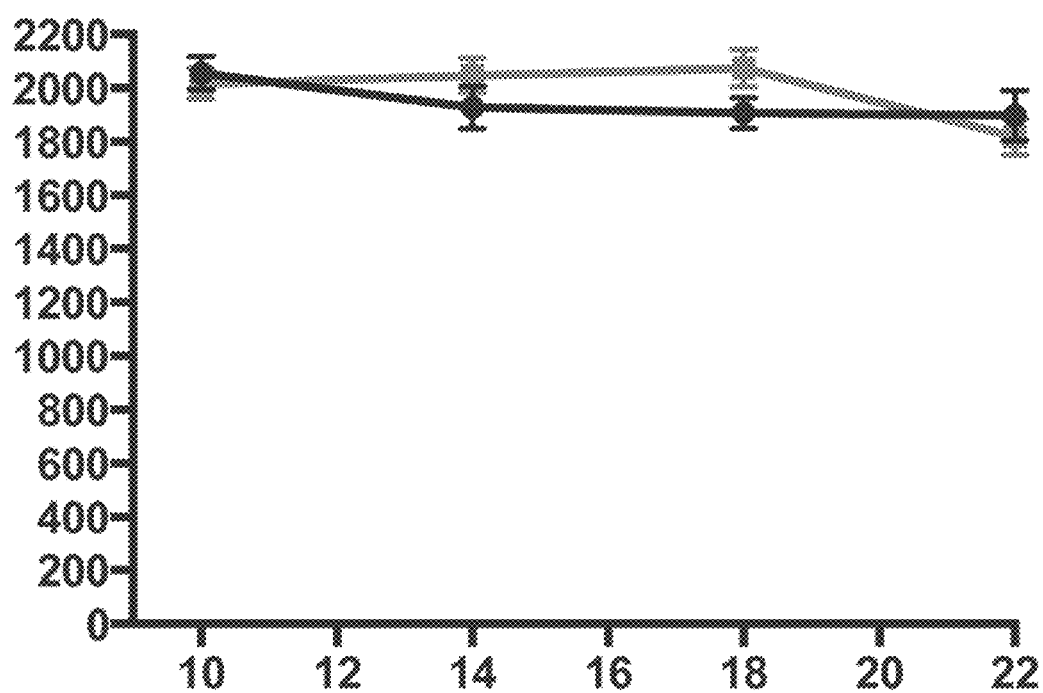
Figure 5F:
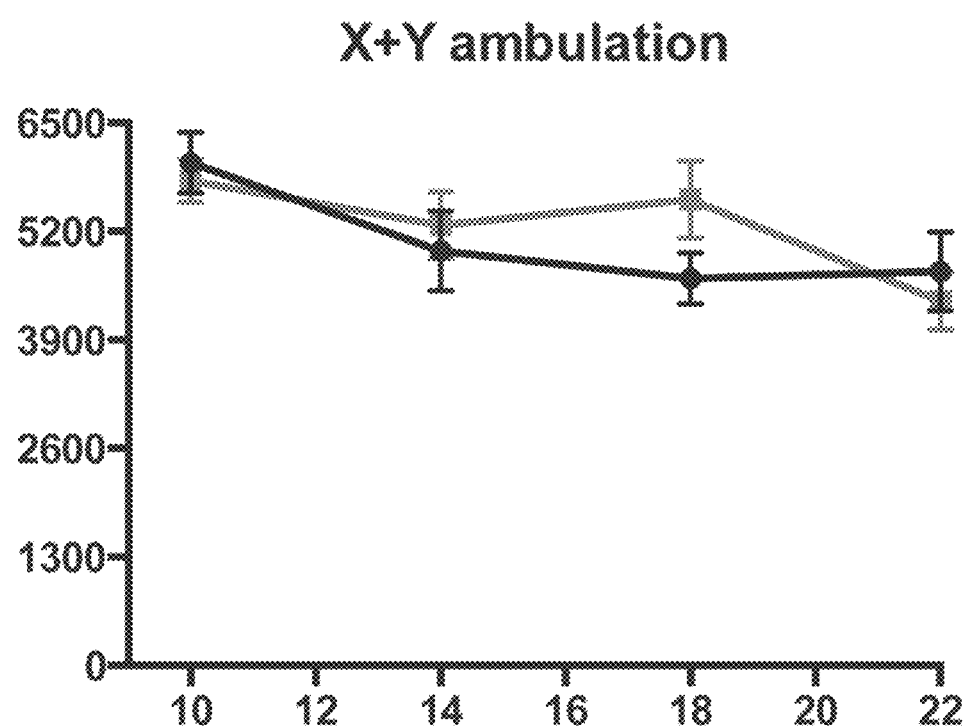
Figure 5G:
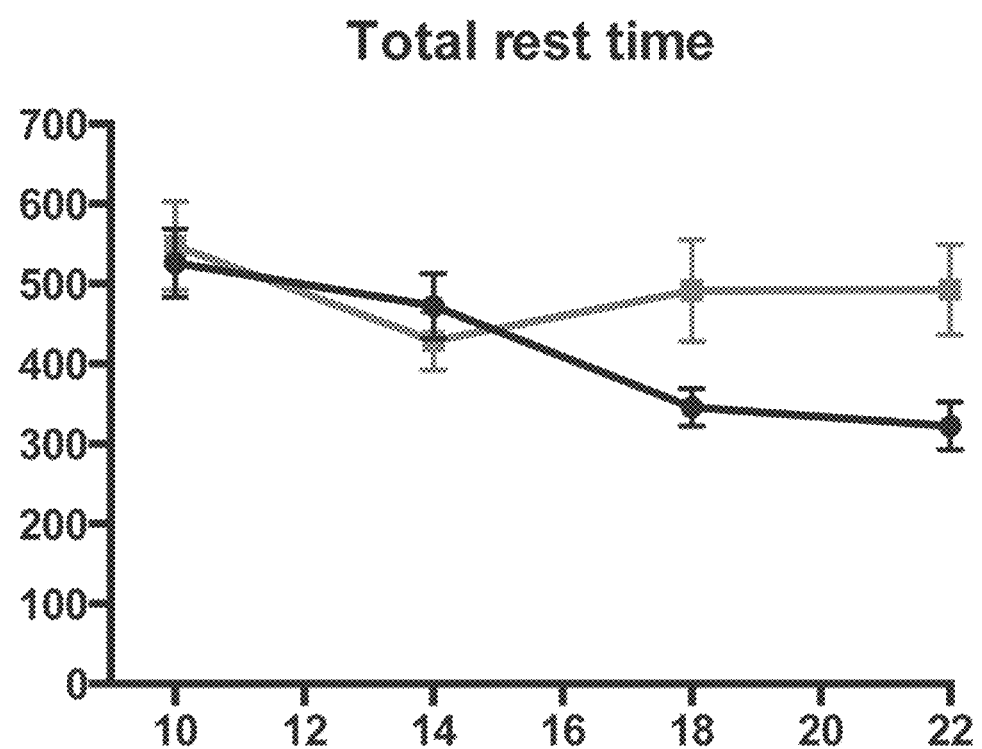
Figure 5H:
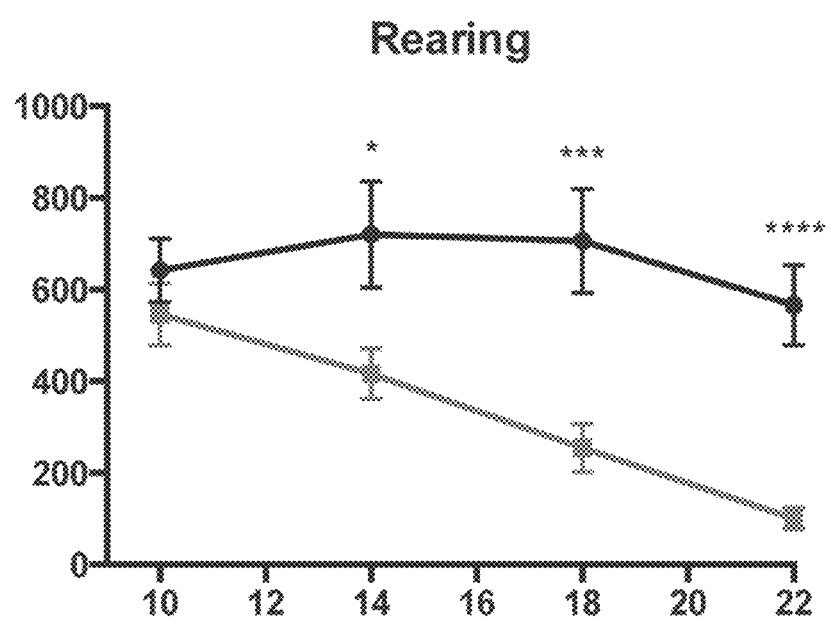
Figure 6A:
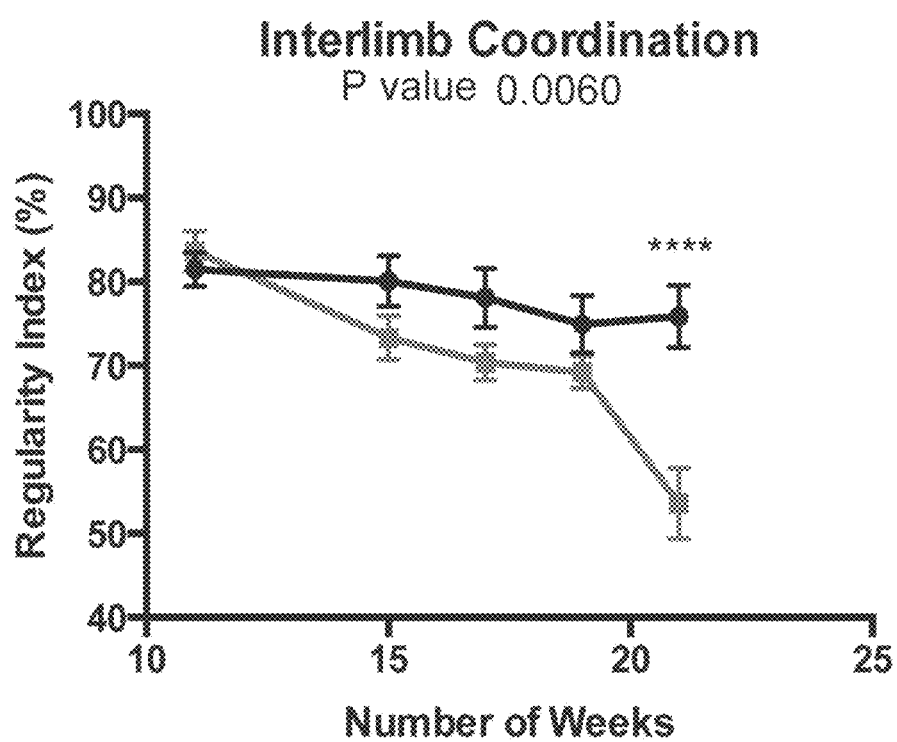
FIGS. 6A-F shows the catwalk behavior, e.g., interlimb coordination (FIG. 6A), paw pressure (FIG. 6B), paw print area (FIG. 6C), stride length (FIG. 6D), stance phase (FIG. 6E), swing phase (FIG. 6F), swing speed (FIG. 6G), and duty cycle (FIG. 6H) of wild-type (-●-); n=14) and DR6$^{-/-}$ (knockout; -■-n=18) animals between 10-21 weeks of age. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.
Figure 6B:
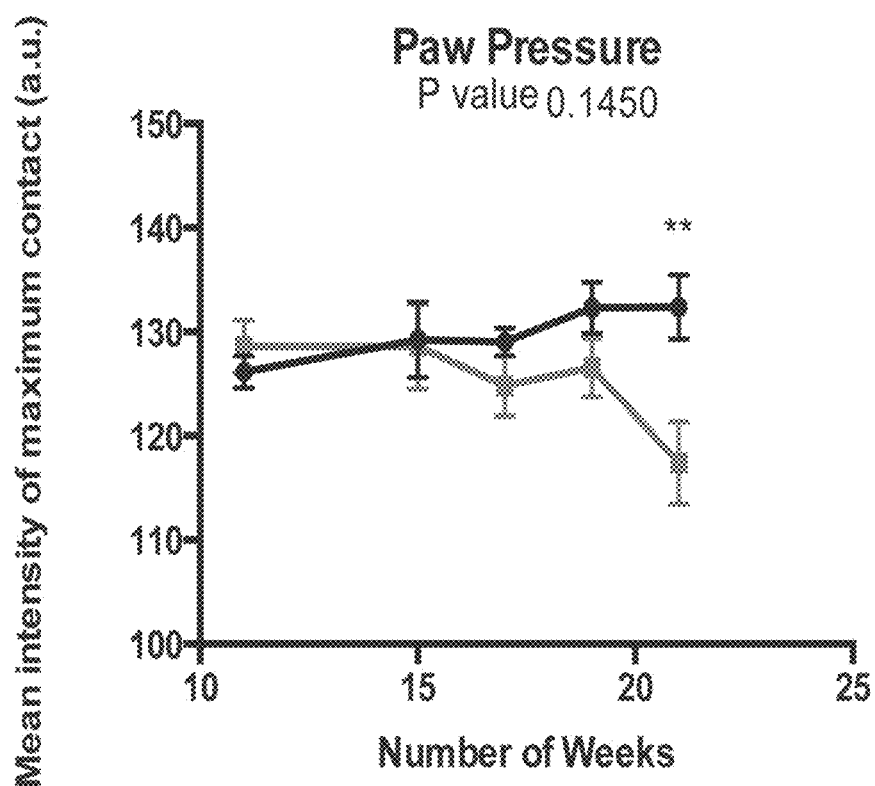
Figure 6C:
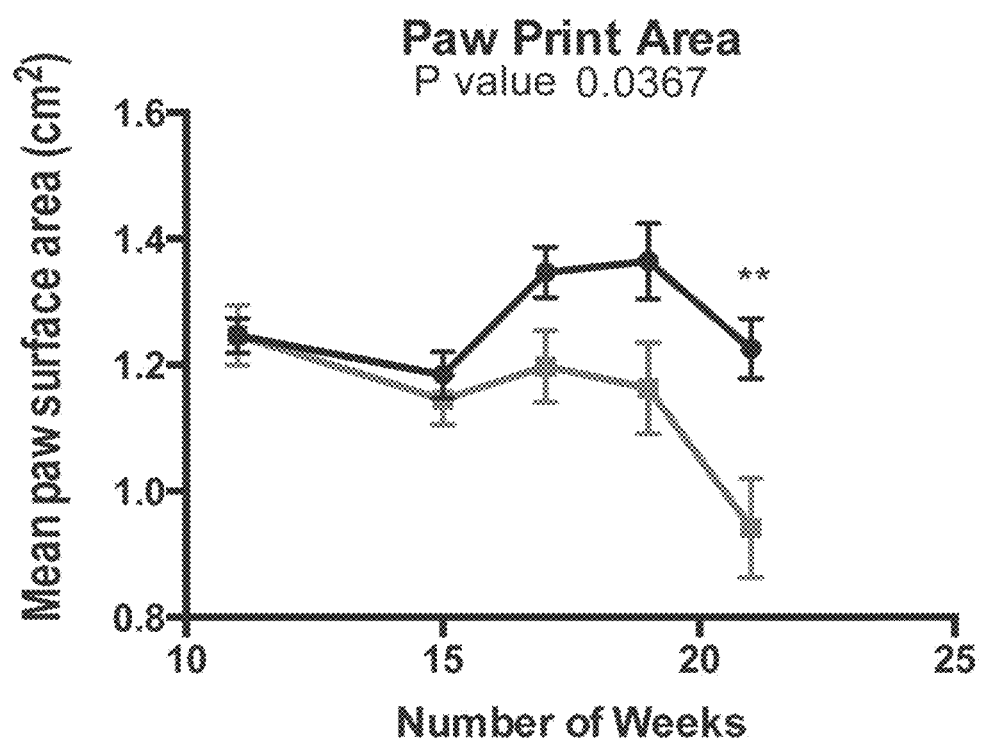
Figure 6D:
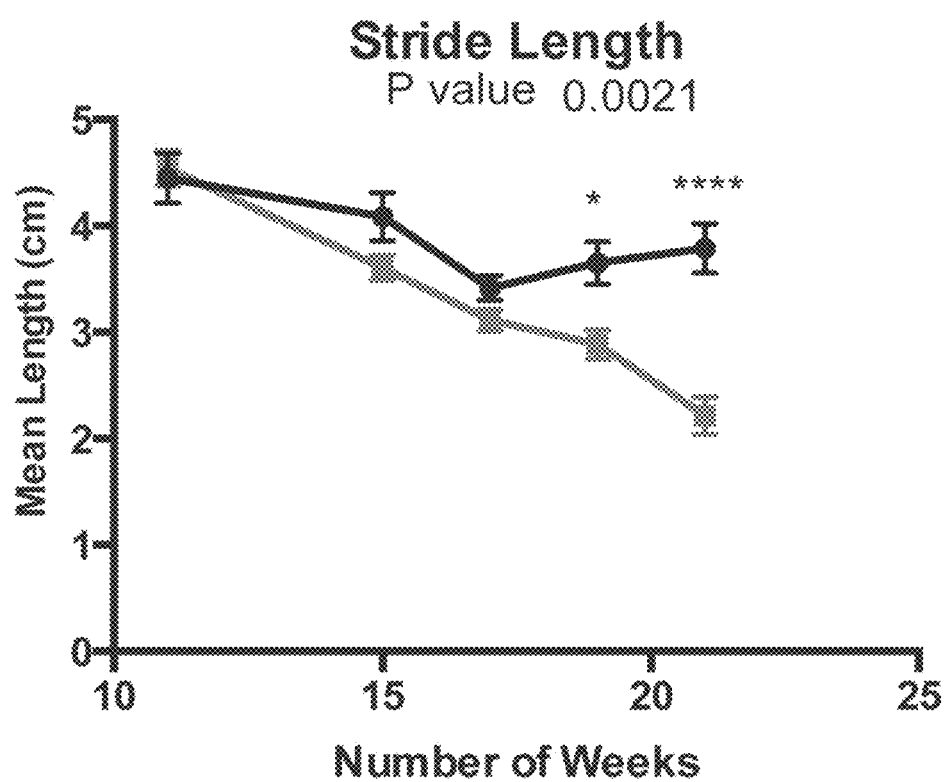
Figure 6E:
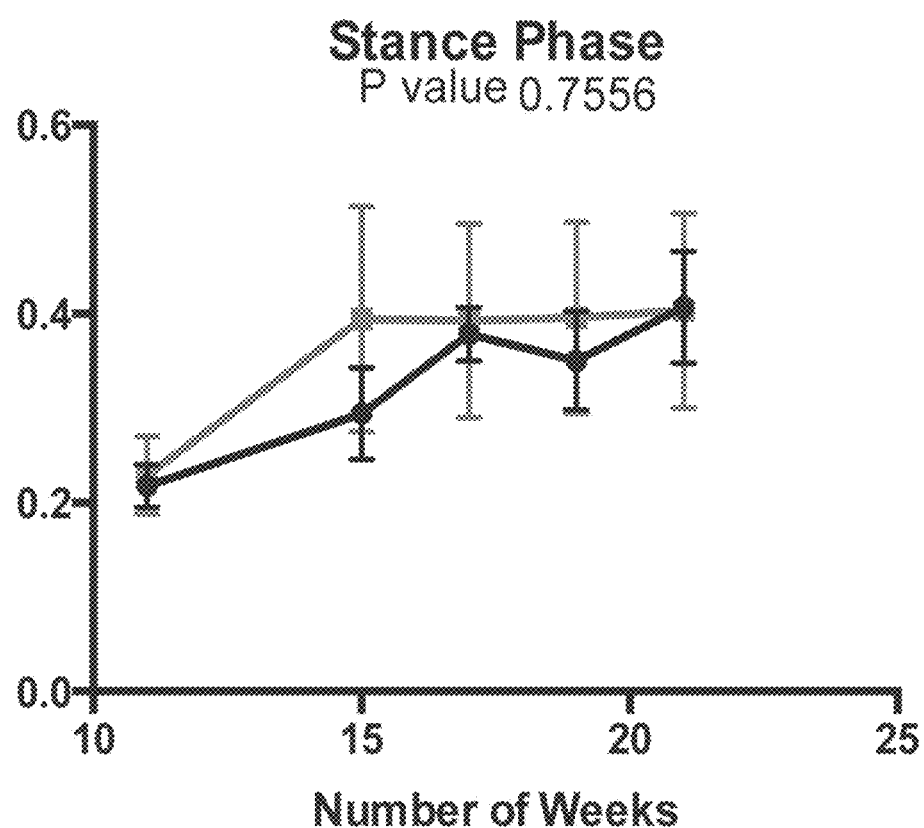
Figure 6F:
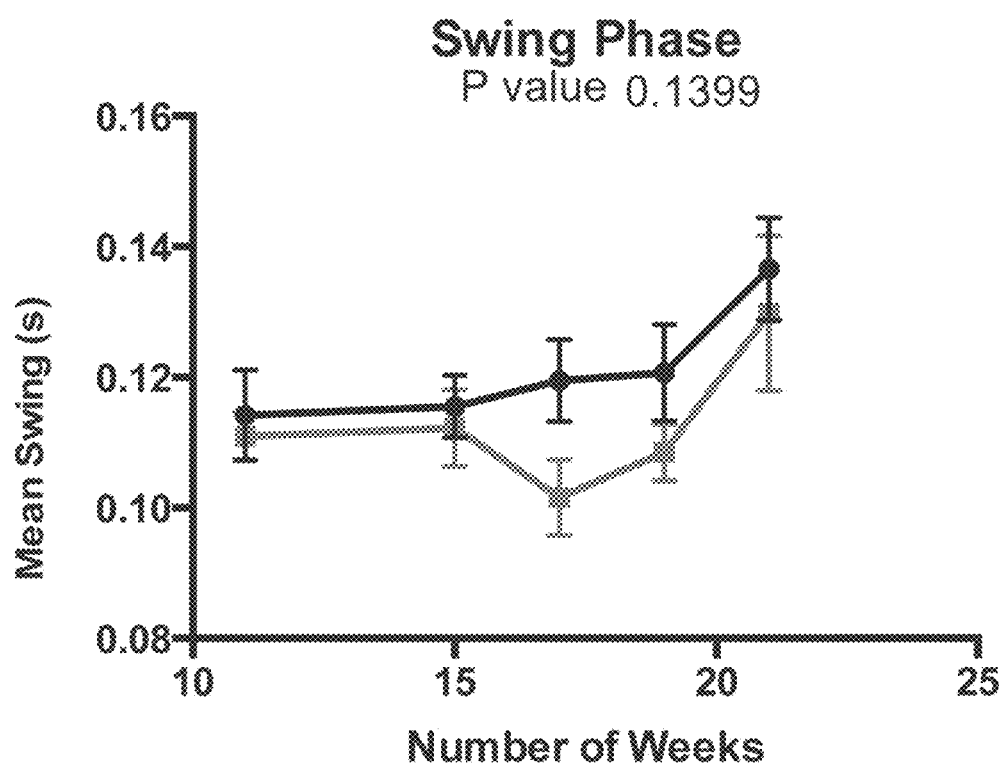
Figure 6G:
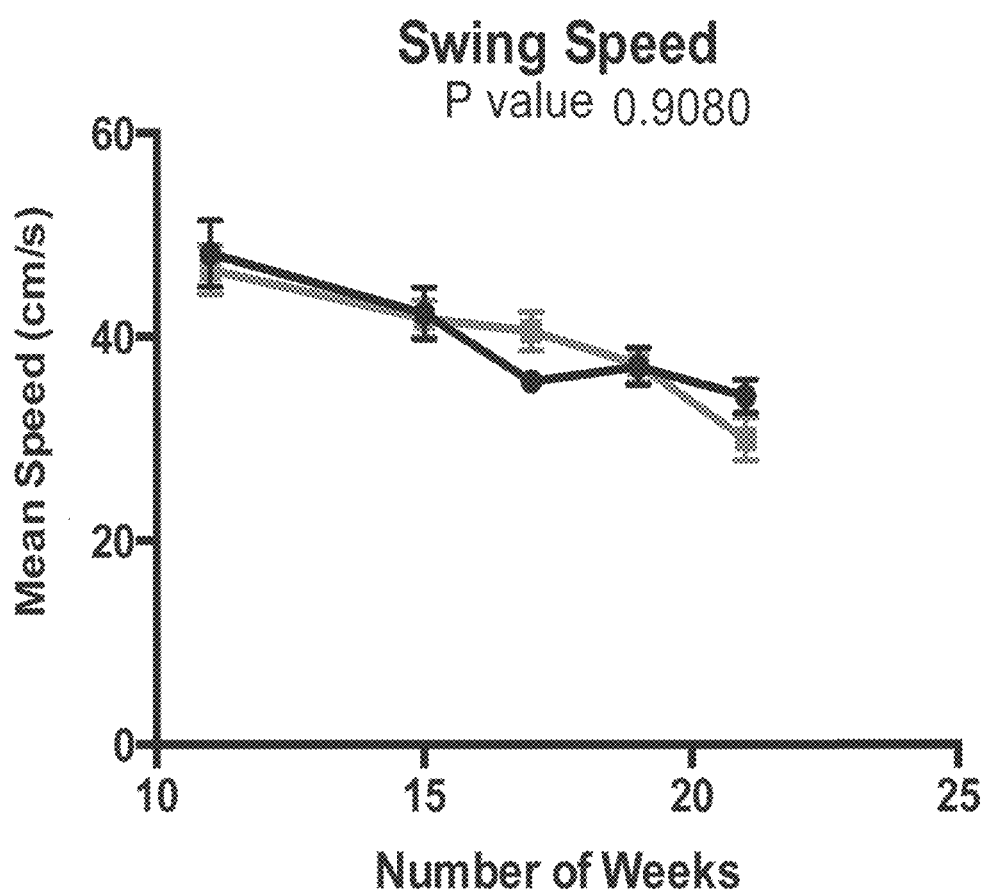
Figure 6H:
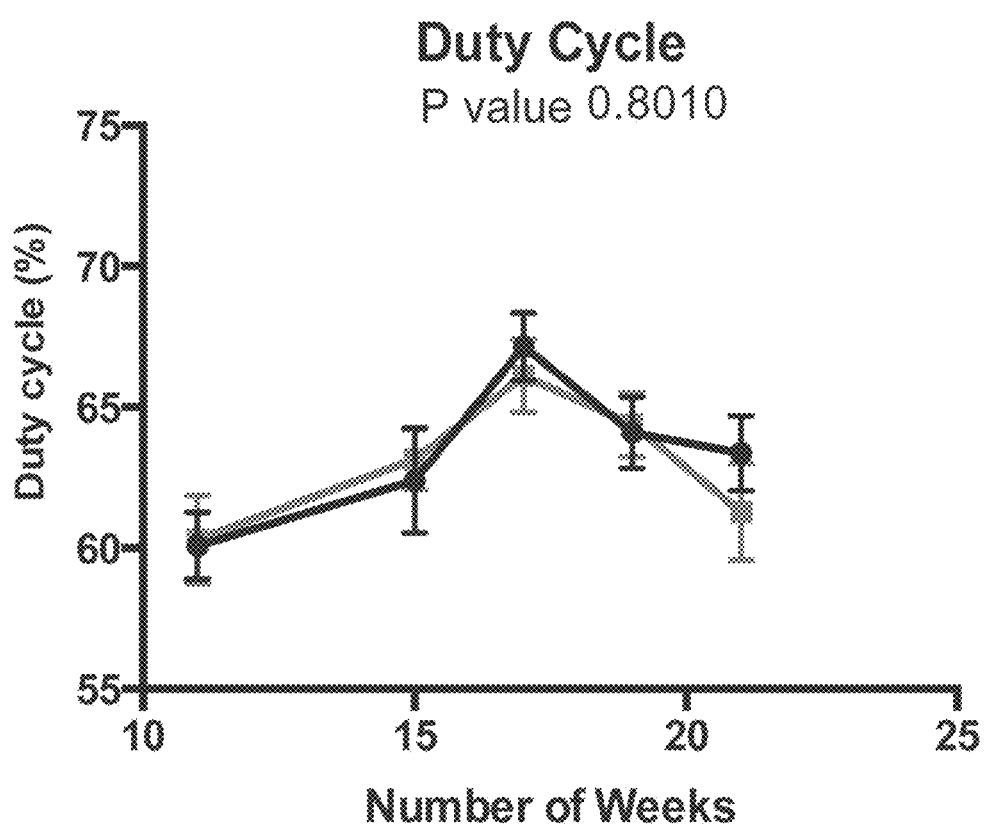
Figure 7A:
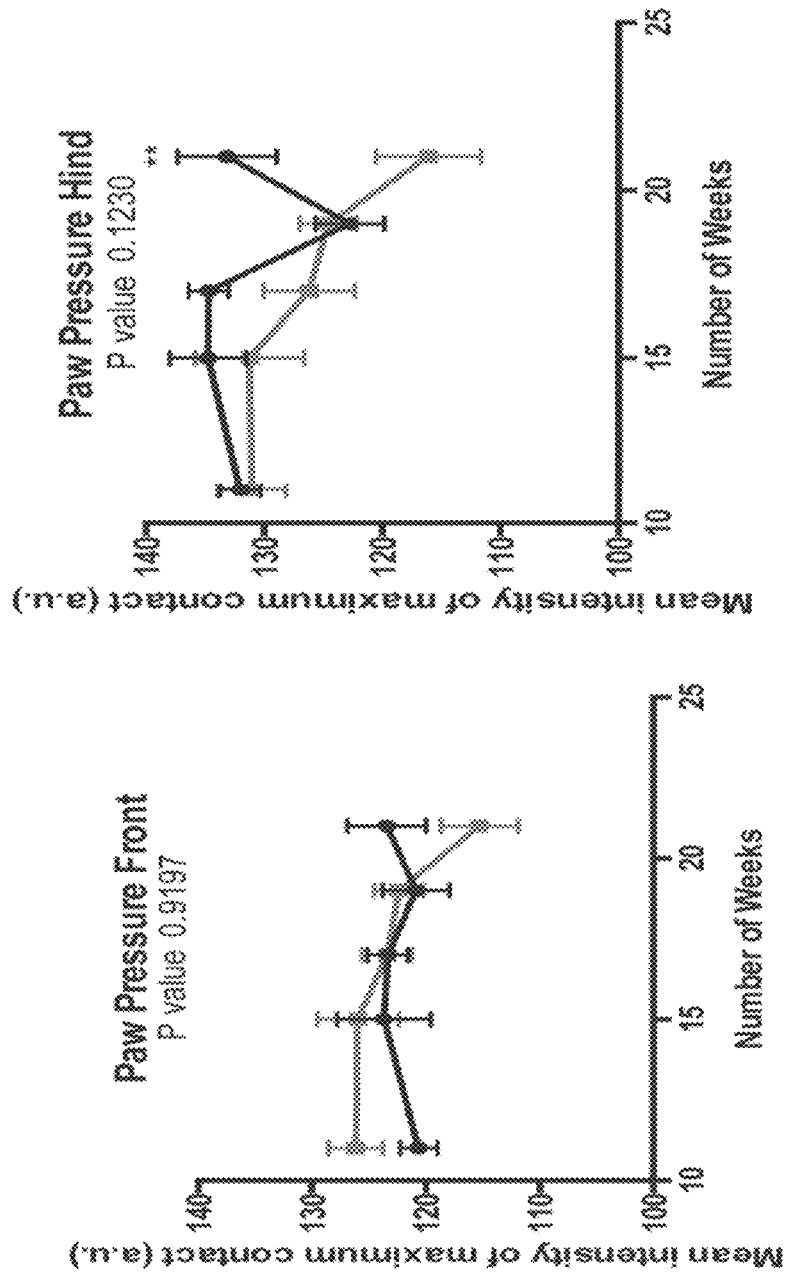
FIGS. 7A-G show the gait ability of the front and hind legs of wild-type (●, n=14) and DR6$^{-/-}$ (■; n=18) animals between 9 and 21 weeks of age (x-axis).
Figure 7B:
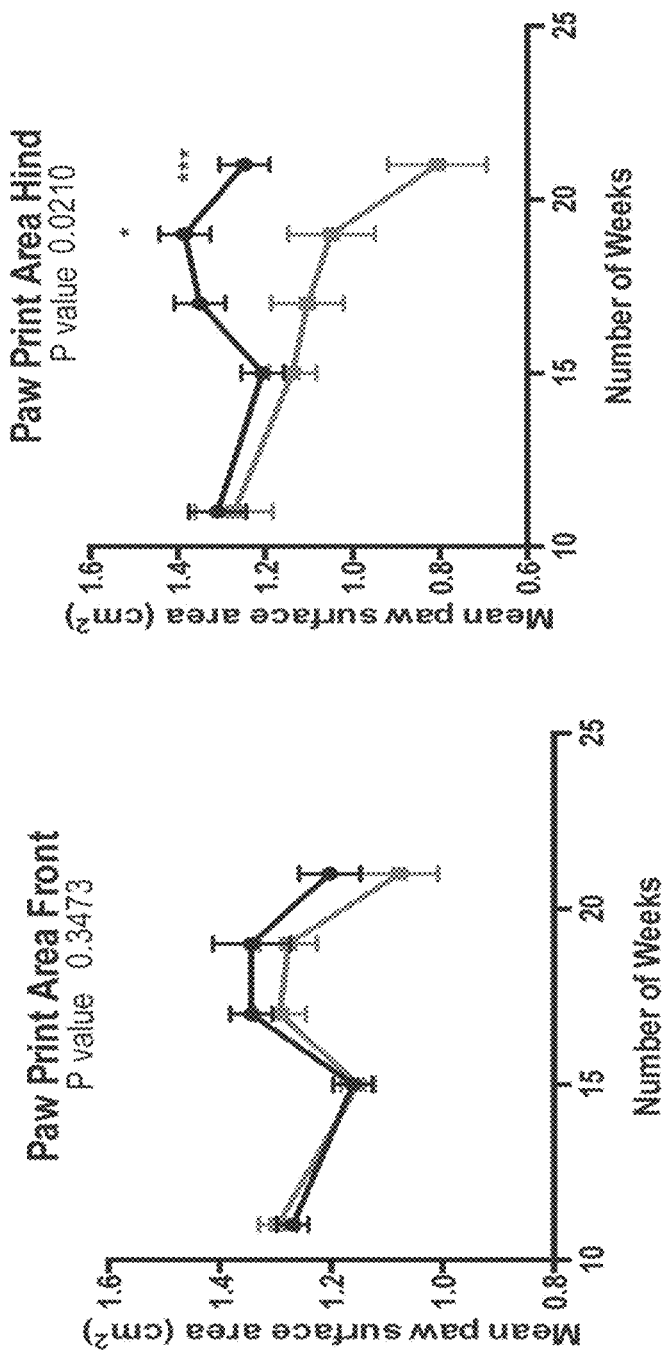
Figure 7C:
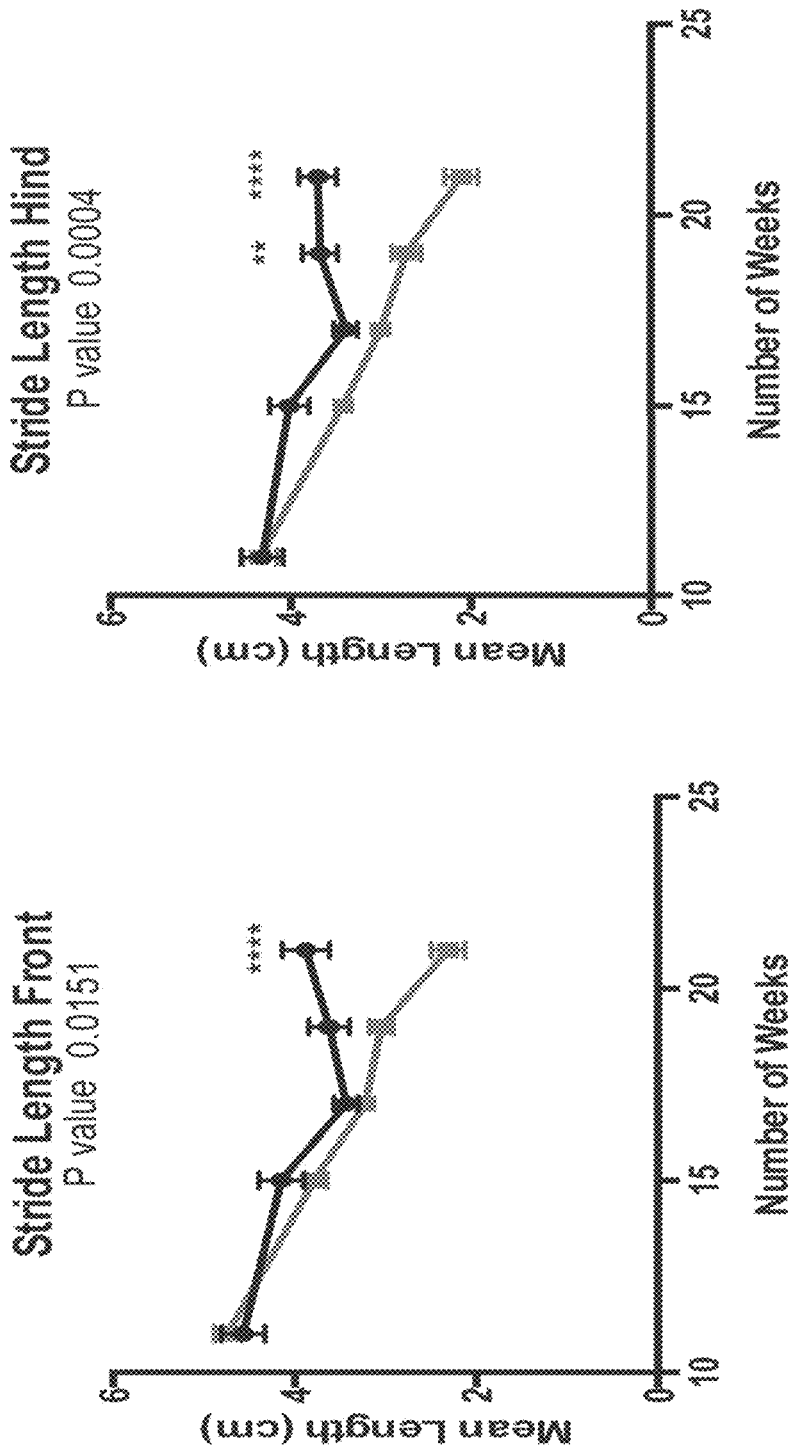
Figure 7D:
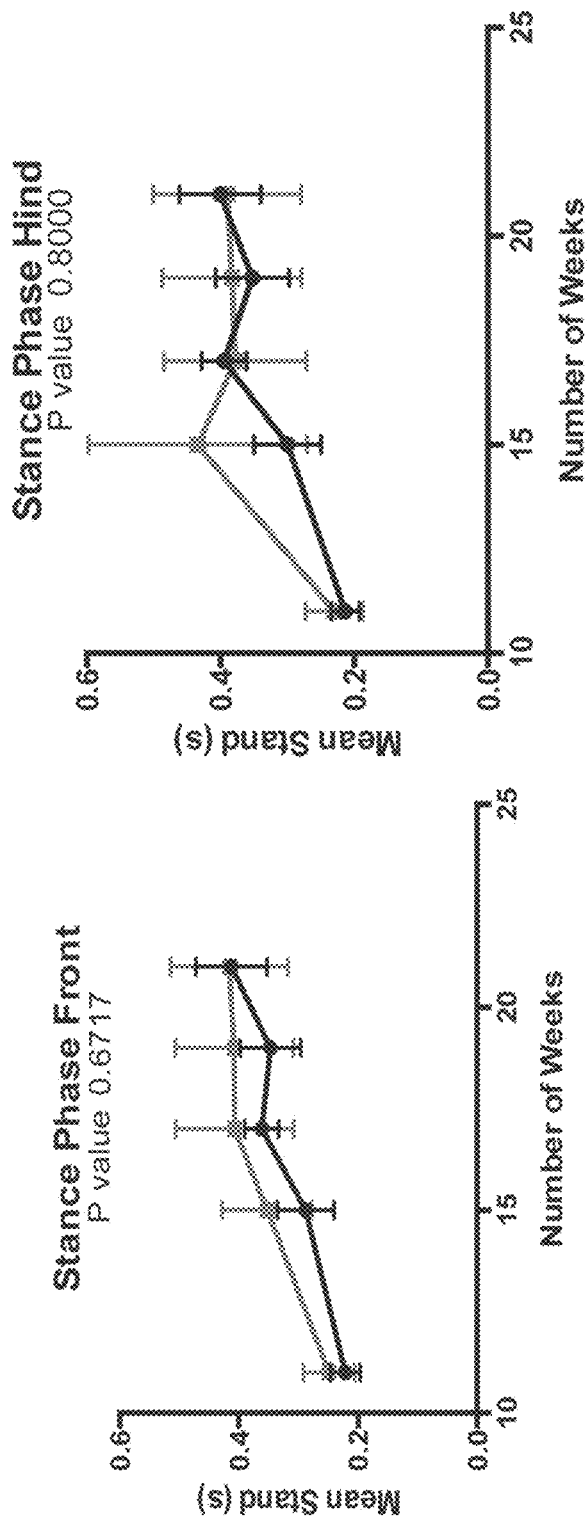
Figure 7E:
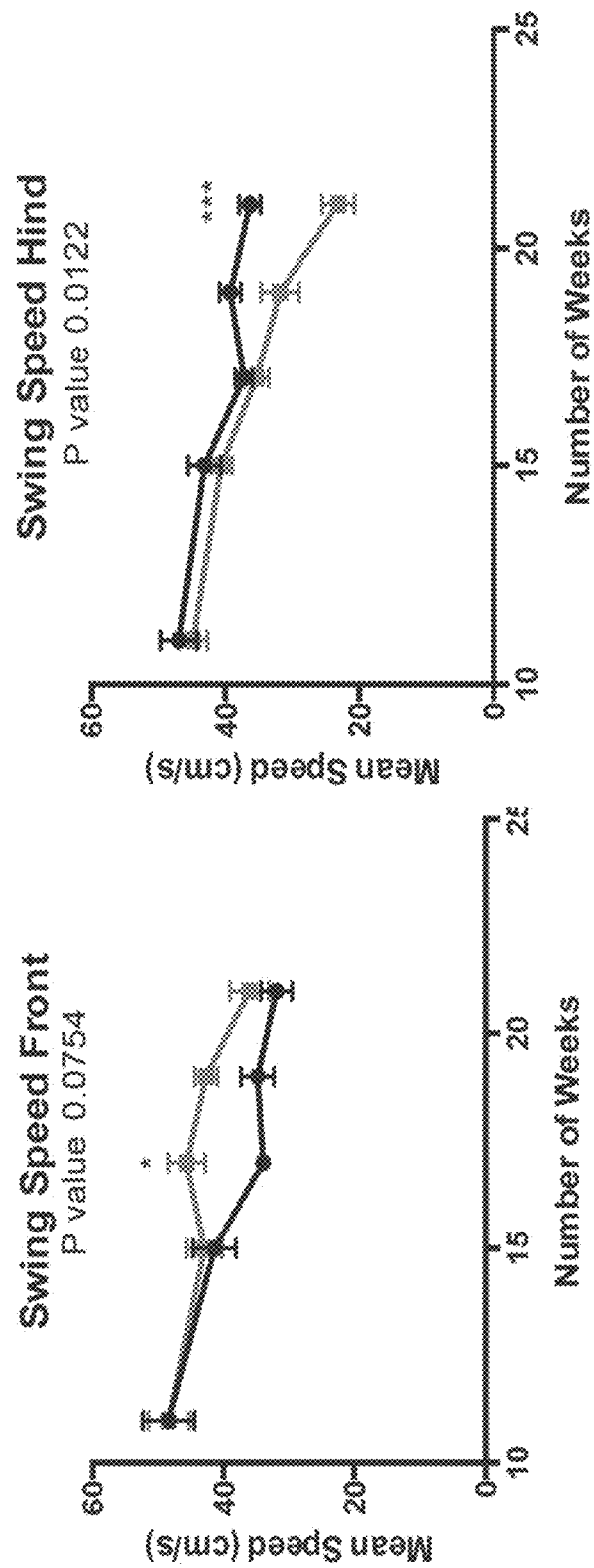
Figure 7F:
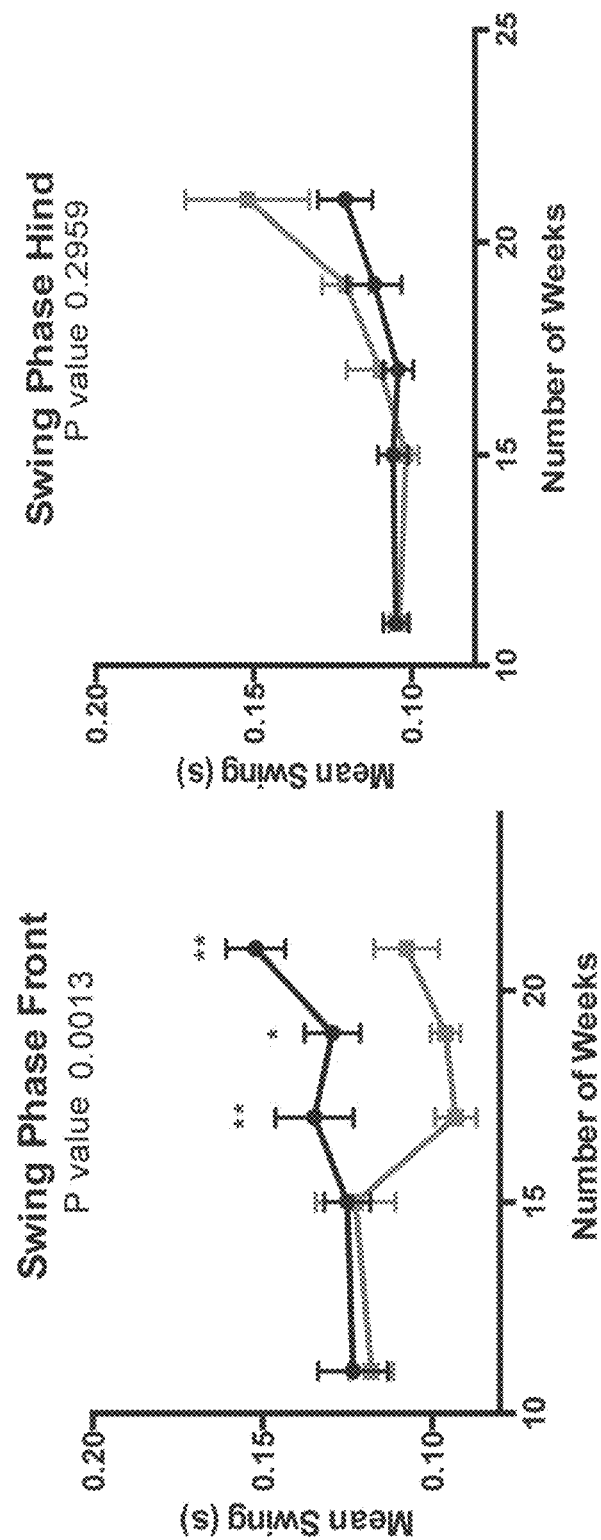
Figure 7G:
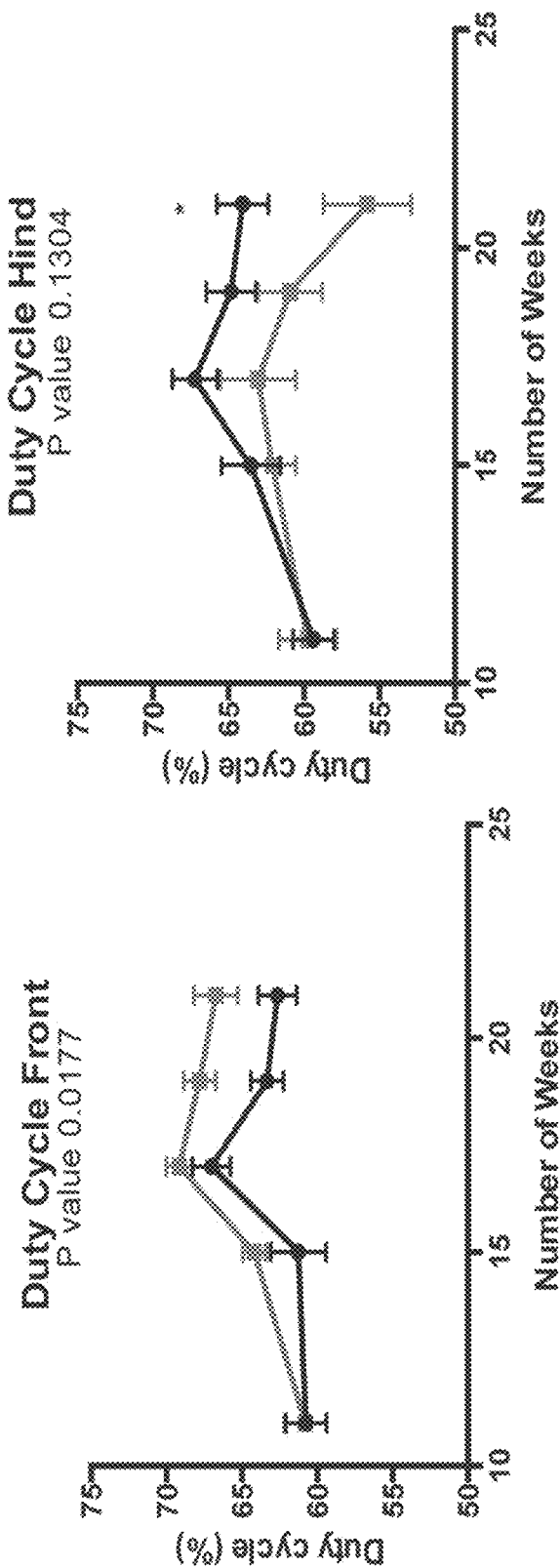
Figure 8:
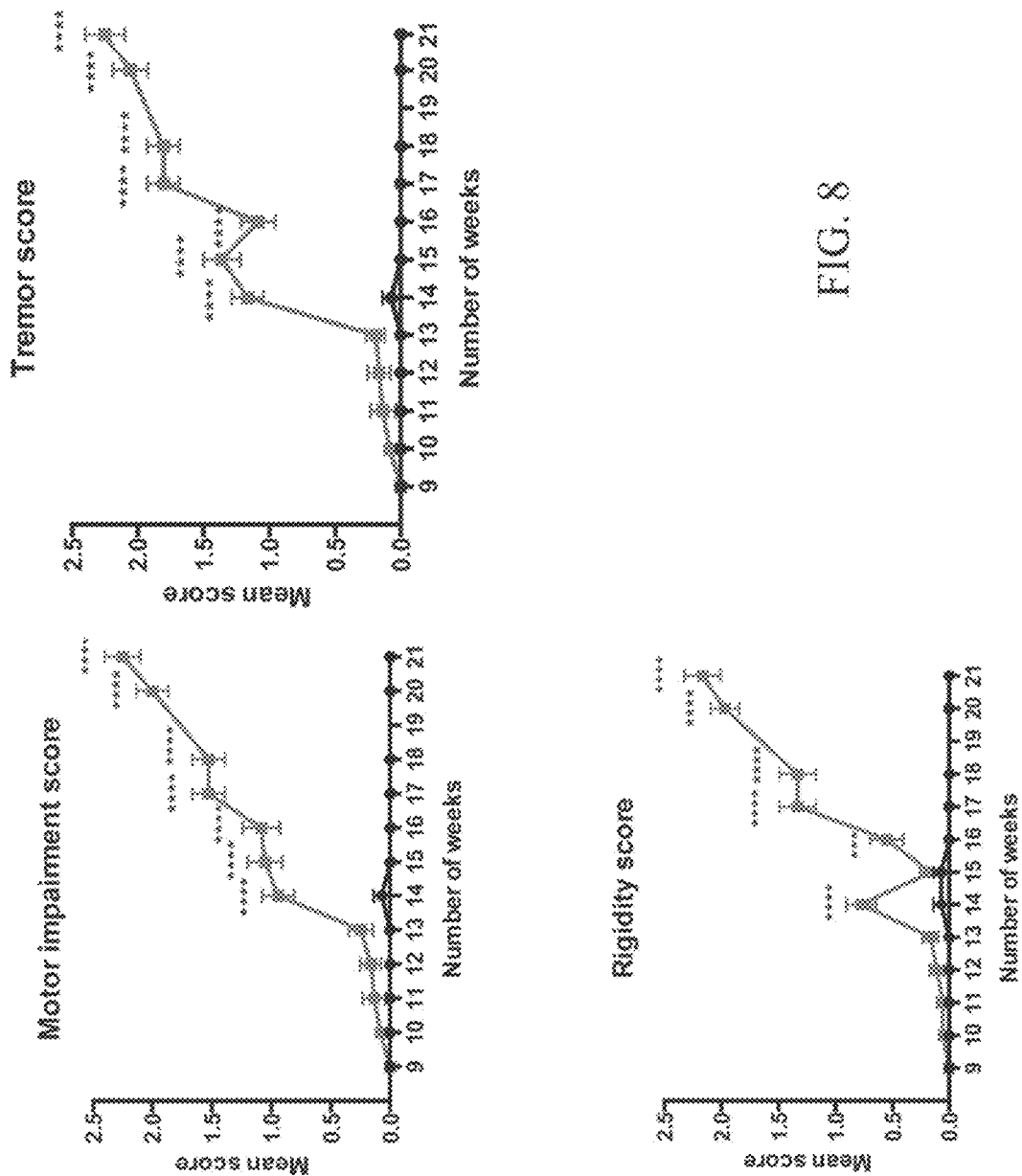
FIG. 8 shows the neurological scoring, e.g., motor impairment score, tremor score, and rigidity score, of wild-type (-●-) and DR6$^{-/-}$ (knockout; -■-) animals between 10-21 weeks of age. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.

Amyotrophic lateral sclerosis ("ALS"), also called Lou Gehrig's disease, is a progressive, fatal neurological disease affecting as many as 20,000 Americans with 5,000 new cases occurring in the United States each year. The disorder belongs to a class of disorders known as motor neuron diseases. ALS occurs when specific nerve cells in the brain and spinal cord that control voluntary movement gradually degenerate. Both the brain and spinal cord lose the ability to initiate and send messages to the muscles in the body. The muscles, which are unable to function, gradually atrophy and twitch.

ALS manifests itself in different ways, depending on which muscles weaken first. Symptoms may include tripping and falling, loss of motor control in hands and arms, difficulty speaking, swallowing and/or breathing, persistent fatigue, and twitching and cramping, sometimes quite severely. Eventually, when the muscles in the diaphragm and chest wall become too weak, patients require a ventilator to breathe. Most people with ALS die from respiratory failure, usually 3 to 5 years after being diagnosed; however, some people survive 10 or more years after diagnosis. ALS strikes in mid-life. Men are about one-and-a-half times more likely to get the disease than women.

There is no cure for ALS, nor is there a proven therapy that will prevent or reverse the course of the disorder. The Food and Drug Administration (FDA) recently approved riluzole, the first drug that has been shown to prolong the survival of ALS patients. Patients may also receive supportive treatments that address some of their symptoms.

Provided herein is an animal model for ALS, which may be useful in finding candidate agents that may be useful in treating ALS in humans.

The techniques and procedures described or referenced herein are generally well understood and commonly employed using conventional methodology by those skilled in the art, such as, for example, the widely utilized molecular cloning methodologies described in Sambrook et al., Molecular Cloning: A Laboratory Manual 2nd. edition (1989) Cold Spring Harbor Laboratory Press, Cold Spring Harbor, N.Y. As appropriate, procedures involving the use of commercially available kits and reagents are generally carried out in accordance with manufacturer defined protocols and/or parameters unless otherwise noted.

Before the present methods and assays are described, it is to be understood that this invention is not limited to the particular methodology, protocols, cell lines, animal species or genera, constructs, and reagents described as such may, of course, vary. It must be noted that the singular forms "a", "and", and "the" include plural referents unless the context clearly dictates otherwise. Thus, for example, reference to "a genetic alteration" includes a plurality of such alterations and reference to "a probe" includes reference to one or more probes and equivalents thereof known to those skilled in the art, and so forth. All numbers recited in the specification and associated claims (e.g. amino acids 22-81, 1-354 etc.) are understood to be modified by the term "about".

All publications mentioned herein are incorporated herein by reference to disclose and describe the methods and/or materials in connection with which the publications are cited. Publications cited herein are cited for their disclosure prior to the filing date of the present application. Nothing here is to be construed as an admission that the inventors are not entitled to antedate the publications by virtue of an earlier priority date or prior date of invention. Further the actual publication dates may be different from those shown and require independent verification.

Definitions

The term "embryonic stem cell" or "ES cell" includes an embryo-derived totipotent or pluripotent cell that is capable of contributing to any tissue of the developing embryo upon introduction into an embryo. The term "pluripotent cell" includes an undifferentiated cell that possesses the ability to develop into more than one differentiated cell types.

Some targeting vectors are "large targeting vectors" or "LTVECs," which includes large targeting vectors for eukaryotic cells that comprise homology arms that correspond to and are derived from nucleic acid sequences larger than those typically used by other approaches intended to perform homologous gene targeting in eukaryotic cells. Examples of LTVEC, include, but are not limited to, bacterial homologous chromosome (BAC) and yeast artificial chromosome (YAC). Examples of generating targeted genetic modifications using LTVECs are disclosed, for example, in WO 2015/088643, US 2015/0159175, US 2015/0159174, US 2014/0310828, US 2014/0309487, and US 2013-0309670, each of which is herein incorporated by reference in its entirety for all purposes. LTVECs also include targeting vectors comprising nucleic acid inserts having nucleic acid sequences larger than those typically used by other approaches intended to perform homologous recombination in cells. For example, LTVECs make possible the modification of large loci that cannot be accommodated by traditional plasmid-based targeting vectors because of their size limitations. For example, the targeted locus can be (i.e., the 5' and 3' homology arms can correspond to) a locus of the cell that is not targetable using a conventional method or that can be targeted only incorrectly or only with significantly low efficiency in the absence of a nick or double-strand break induced by a nuclease agent (e.g., a Cas protein).

Examples of LTVECs include vectors derived from a bacterial artificial chromosome (BAC), a human artificial chromosome, or a yeast artificial chromosome (YAC). Non-limiting examples of LTVECs and methods for making them are described, e.g., in U.S. Pat. Nos. 6,586,251; 6,596,541; 7,105,348; and WO 2002/036789 (PCT/US01/45375), each of which is herein incorporated by reference. LTVECs can be in linear form or in circular form.

LTVECs can be of any length, including, for example, at least 10 kb or from about 50 kb to about 400 kb or greater. The size of an LTVEC can be too large to enable screening of targeting events by conventional assays, e.g., southern blotting and long-range (e.g., 1 kb to 5 kb) PCR. The sum total of the 5' homology arm and the 3' homology arm can be, for example, at least 10 kb (each homology arm can range, for example, from about 5 kb to about 200 kb). The LTVEC and nucleic acid insert can be designed to allow for a deletion at the target locus of a length, for example, from about 5 kb to about 3 Mb (e.g., about 500 kb or greater). Likewise, the LTVEC and nucleic acid insert can be designed to allow for an insertion into the target locus of an exogenous nucleic acid sequence of a length, for example, ranging from about 5 kb to about 400 kb or greater.

The term "recombination site" includes a nucleotide sequence that is recognized by a site-specific recombinase and that can serve as a substrate for a recombination event.

The term "site-specific recombinase" includes a group of enzymes that can facilitate recombination between "recombination sites". Examples of "site-specific recombinase" include, but are not limited to, Cre, Flp, and Dre recombinases.

The term "germline" in reference to a nucleic acid sequence includes a nucleic acid sequence that can be passed to progeny.

The phrase "operably linked" means components are linked to function together in their intended manner. In one instance, a nucleic acid sequence encoding a protein may be operably linked to regulatory sequences (e.g., promoter, enhancer, silencer sequence, etc.) so as to retain proper transcriptional regulation. In another instance, a nucleic acid sequence encoding a signal peptide may be operably linked to a nucleic acid sequence encoding, e.g., a transmembrane domain, so as to translate into a polypeptide comprising the signal peptide operably fused to the transmembrane domain, wherein both the signal peptide and transmembrane domain retain their respective biological functions.

The term "locus" is defined as a segment of DNA within the genomic DNA. For example, a DR6 locus is a segment of DNA within the genomic DNA that encodes DR6, and includes nontranslated and/or regulatory DNA involved with the expression of DR6.

The TNFR family member called Death Receptor 6 (DR6) (also referred to in literature as "TR9"; also known in literature as TNF Receptor Superfamily Member 21 or TNFRS21) has been described as a type I transmembrane receptor having four extracellular cysteine-rich motifs and a cytoplasmic death domain structure (Pan et al., FEBS Lett., 431:351-356 (1998); see also U.S. Pat. Nos. 6,358,508; 6,667,390; 6,919,078; 6,949,358). It has been reported that overexpression of DR6 in certain transfected cell lines resulted in apoptosis and activation of both NF-kB and JNK (Pan et al., FEBS Letters, 431:351-356 (1998)). In a DR6-deficient mouse model, T cells were substantially impaired in JNK activation, and when DR6 (−/−) mice were challenged with protein antigen, their T cells were found to hyperproliferate and display a profound polarization toward a Th2 response (whereas Th1 differentiation was not equivalently affected) (Zhao et al., J. Exp. Med., 194:1441-1448 (2001)). It was further reported that targeted disruption of DR6 resulted in enhanced T helper 2 (Th2) differentiation in vitro (Zhao et al., supra). Various uses of DR6 agonists or antagonists in modulating B-cell mediated or neurological conditions were described in US 2005/0069540 published Mar. 31, 2005 and US 2010/0203044 published Aug. 12, 2010.

The murine DR6 receptor locus is found on chromosome 17 and has 6 exons. It encodes a 655 amino acid protein (SEQ ID NO:15) having a putative signal sequence (amino acids 1-41; amino acids −41 to −1 of SEQ ID NO:15), an extracellular domain (amino acids 42-349; amino acids 1-308 of SEQ ID NO:15), a transmembrane domain (amino acids 350-370; amino acids 309-329 of SEQ ID NO:15), followed by a cytoplasmic domain (amino acids 371-655; amino acids 330-614 of SEQ ID NO:15). A mature DR6 protein refers to the translated polypeptide after cleavage of its signal protein, e.g., a mature murine DR6 protein refers to amino acids 42-655; amino acids 1-614 of SEQ ID NO: 15.

Provided in Table 1 below is brief description of the sequences identified by sequence number.

TABLE 1

Description of Sequences.

| SEQ ID NO | Type | Description |
|---|---|---|
| 1 | DNA | 5' homology arm of Zen-Ub1 LTVEC depicted in FIG. 1 |
| 2 | DNA | ROR1 operably linked to β-galactosidase and poly-A region |
| 3 | DNA | Floxed neo'cassette |
| 4 | DNA | 3' homology arm of Zen-Ub1 LTVEC depicted in FIG. 1 |

TABLE 1-continued

Description of Sequences.

| SEQ ID NO | Type | Description |
|---|---|---|
| 5 | DNA | Entire Zen-Ub1 LTVEC depicted in FIG. 1 |
| 6 | DNA | mDR6 signal peptide |
| 7 | DNA | mROR1 transmembrane domain |
| 8 | DNA | β-galactosidase reporter gene |
| 9 | DNA | poly-A region of mDR6 signal/ROR1/β-galactosidase fusion gene |
| 10 | DNA | Flox recombination sequence |
| 11 | DNA | hUb1 Promoter |
| 12 | DNA | neo$^r$ gene |
| 13 | DNA | poly-A region of neo$^r$ gene |
| 14 | DNA | mDR6 (including signal peptide encoding sequence) |
| 15 | Amino acid | mDR6 (including putative signal peptide(s)) |
| 16 | DNA | Zen-Ub1 LTVEC depicted in FIG. 1 without Floxed neo$^r$cassette |
| 17 | DNA | mDR6 signal/ROR1/β-galactosidase fusion gene |

I. Compositions Comprising Genetic Modification of at Least One DR6 Locus

Non-human animals, cells, tissues, and embryos are provided that comprise a modified DR6 locus, which lacks a nucleotide sequence encoding any portion of an endogenous DR6 cytoplasmic domain and may further comprise a nucleic acid sequence encoding a DR6 signal peptide, transmembrane domain and/or reporter protein. Methods and compositions for manipulating DR6 expression are provided. Targeting compositions directed to modifying DR6 are also provided. Non-human animals, cells, and tissues are provided that exhibit motor neuron dysfunction, e.g., an ALS-like phenotype, associated with modulation of DR6 function. Although the following description is with reference to a survey of certain particular DR6s, the methods and compositions may be practiced with any DR6.

Provided herein are non-human animals, cells, tissues and embryos comprising a modified DR6 locus and/or a nucleic acid that may affect DR6 function or be used for targeted genetic modification (e.g., a reporter knock-in) in the DR6 locus. In such cases, the modified DR6 locus comprises a loss of function mutation in a nucleic acid sequence that encodes the DR6. Also provided are cells, tissues and embryos derived from the non-human animals comprising a loss-of-function mutation of DR6.

The term, "loss-of-function" as it relates to a DR6 can include any modification in a DR6 locus and/or expression of a transgene that results in a decrease or lack of expression of the DR6 and/or a decrease or lack of activity/function of the DR6. The expression level of a DR6 may be measured directly, for example, by assaying for the level of the DR6 in the cell or organism.

In general, the expression level and/or activity of the DR6 is decreased if the DR6 expression level and/or the activity level of the DR6 is statistically lower ($p \leq 0.05$) than the DR6 level in an appropriate control cell or organism that has not been genetically modified or mutagenized to inhibit the expression and/or activity of the DR6. In specific embodiments, the concentration and/or activity of the DR6 is decreased by at least 1%, 5%, 10%, 20%, 30%, 40%, 50%, 60%, 70%, 80%, 90%, 95%, 99% or more relative to a control cell or organism which has not been modified to have the decreased level and/or activity of the DR6.

In other instances, cells or organisms having the targeted genetic modification that reduces the expression level and/or activity of the DR6 are selected using methods that include, but are not limited to, Southern blot analysis, DNA sequencing, PCR analysis, or phenotypic analysis. Such cells or organisms are then employed in the various methods and compositions described herein.

A "subject cell" or "subject organism" is one in which a genetic alteration, such as a genetic modification disclosed herein has been effected, or is a cell/organism which is descended from a cell/organism so altered and which comprises the alteration. A "control" or "control cell" or "control organism" provides a reference point for measuring changes in phenotype of the subject cell or organism. In one embodiment, a control cell/organism is as closely matched as possible with the cell/organism with the genetic modification in the DR6 except it lacks the genetic modification or mutation resulting in the reduced expression and/or activity (for example, the respective cells can originate from the same cell line). In other instances, the control cell/organism may comprise, for example: (a) a wild-type cell/organism, i.e., of the same genotype as the starting material for the genetic alteration which resulted in the subject cell/organism; (b) a cell/organism of the same genotype as the starting material but which has been genetically modified with a null construct (i.e. with a construct which has no known effect on the trait of interest, such as a construct comprising a marker gene); (c) a cell/organism which is a non-genetically modified progeny of a subject cell/organism (i.e., the control cell and the subject cell originate from the same cell line); (d) a cell/organism genetically identical to the subject cell/organism but which is not exposed to conditions or stimuli that would induce expression of the gene of interest; or (e) the subject cell/organism itself, under conditions in which the genetic modification does not result in an alteration in expression of the polynucleotide of interest.

The term "animal," in reference to animals, cells, tissues or embryos, includes mammals, fishes, and birds. Mammals include, e.g., humans, non-human primates, monkey, ape, cat, dog, horse, bull, deer, bison, sheep, rodents (e.g., mice, rats, hamsters, guinea pigs), livestock (e.g., bovine species, e.g., cows, steer, etc.; ovine species, e.g., sheep, goats, etc.; and porcine species, e.g., pigs and boars). Birds include, e.g., chickens, turkeys, ostrich, geese, ducks, etc. Domesticated animals and agricultural animals are also included. The phrase "non-human animal," in reference to animals, cells, tissues or embryos, excludes humans.

In one embodiment the animal is a non-human animal. In another embodiment, the non-human animal is a mammal. In another embodiment, the mammal is a rodent. In a further embodiment, the rodent is a mouse, a rat or a hamster. In a further embodiment, the rodent is a mouse or a rat. In some embodiments, the rodent is a mouse.

Genetic modifications as described herein can include one or more deletions from a DR6 locus, additions to a DR6 locus, replacement of a DR6 locus or a portion thereof, and/or any combination thereof. The locus may comprise coding regions or non-coding regulatory regions. A genetic modification as described herein may also include insertion of a transgene in the genome outside of the DR6 locus, wherein the expression of the transgene interferes with, e.g., competes with, endogenous DR6 protein for ligand binding, placement in the cell membrane, etc.

The genetic modifications provided herein may be targeted to a DR6 locus. A loss-of-function of DR6 can result from a targeted genetic modification in the DR6 gene (i.e., a genetic modification in a regulatory region, the coding region, exons, and/or introns etc.). Such targeted modifications include, but are not limited to, additions of one or more nucleotides, deletions of one or more nucleotides, substitutions of one or more nucleotides, a disruption of the DR6 locus, a knockout of the DR6 locus or a portion thereof, a knock-in of the DR6 locus or a portion thereof, a replacement of an endogenous DR6 nucleic acid sequence or a portion thereof with a heterologous nucleic acid sequence, or a combination thereof. In specific embodiments, at least 1, 2, 3, 4, 5, 7, 8, 9, 10, 50, 100, 400 or more nucleotides are changed to form the targeted genomic modification.

In one embodiment, the loss-of-function mutation is characterized by a disruption or a knockout of at least one DR6 function.

The DR6 locus can be genetically modified in any region of the locus such that the modification results in modulates DR6 function. In one embodiment, the modification of the DR6 locus comprises a deletion of the entire DR6 coding region or a portion thereof. In one embodiment, the modified DR6 locus comprises a deletion of one or more exons that encode the mature DR6 protein, or a portion thereof. In another embodiment, the deletion comprises a deletion of one or more exons within the DR6 locus starting in a first, second, third, fourth, fifth and/or sixth exon of the DR6 locus. In other embodiments, the deletion comprises a deletion of one or more exons within the DR6 locus starting in a second exon of the DR6 locus.

In some cases, the DR6 locus or a portion thereof is replaced with an insert nucleic acid. In such cases, the replacement can be a replacement of the entire RNA coding region of the DR6 locus or a portion thereof with the insert nucleic acid, a replacement of one or more exons of the DR6 locus with the insert nucleic acid, a replacement of one or more exons within the DR6 locus starting in the first exon of the DR6 locus with the insert nucleic acid or a replacement of one or more exons within the DR6 locus starting in the second exon with the insert nucleic acid.

In some instances, the insert nucleic acid is positioned in the DR6 locus such that it is in operable linkage with an endogenous DR6 promoter such that the endogenous DR6 promoter drives expression of the insert nucleic acid. In such cases, the expression of the nucleic acid sequence follows an expression pattern of the DR6.

In one embodiment, the DR6 locus or portion thereof is replaced with an insert nucleic acid comprising a first nucleic acid sequence that encodes a reporter. For example, in the case where the insert nucleic acid comprises a reporter gene and is placed into the DR6 locus in operable linkage to the DR6 promoter, the expression of the reporter gene is driven by the endogenous DR6 promoter. Alternatively, the insert nucleic acid is not inserted in operable linkage with the endogenous DR6 promoter. In such cases, the insert nucleic acid can comprise a promoter. In one embodiment, the insert nucleic acid comprises a reporter gene operably linked to a promoter that drives expression of the reporter gene.

In some embodiments, the insert nucleic acid may comprise an endogenous DR6 signal sequence, e.g., may be positioned in the DR6 locus such that it is in operable linkage with an endogenous DR6 signal sequence, and optionally an endogenous DR6 transmembrane domain. In such cases, the destination of any protein(s) (e.g., reporter) encoded by the insert nucleic acid, located exogenously to the DR6 locus or at an endogenous DR6 locus, is similar to the destination of DR6 (e.g., anchored in the membrane, e.g., with an endogenous transmembrane domain). In one embodiment, the insert nucleic acid may replace the endogenous transmembrane domain. In such and other cases, the insert nucleic acid can comprise a second nucleic acid that encodes a heterologous transmembrane domain. In one embodiment, the insert nucleic acid comprises a reporter gene operably linked to a heterologous transmembrane domain gene, and the insert nucleic acid is inserted into the DR6 gene operably linked to an endogenous DR6 signal sequence such that the expression of the insert nucleic acid is driven by an endogenous DR6 promoter and the protein(s) encoded by the insert nucleic acid is anchored in the membrane according to the signal sequence.

In one embodiment, the DR6 locus or portion thereof is replaced with an insert nucleic acid comprising a further nucleic acid sequence that encodes a selectable marker. In such cases, the further nucleic acid sequence is operably linked to a promoter that drives expression of the selectable marker.

In another embodiment, the DR6 locus or portion thereof is replaced with an insert nucleic acid comprising a transmembrane gene, a reporter gene and a selectable marker gene. In such cases, the reporter gene and/or the selectable marker gene may or may not be operably linked to a promoter.

Various promoters that can be employed in the methods and compositions are provided elsewhere herein.

Such genetic modifications (including those that result in a decrease or a modulation in expression and/or activity of the target DR6) are also capable of being transmitted through the germline. In specific embodiments, the genetic modifications result in a knockout of the desired target locus. Such non-human animals, for example, find use in a variety of experimental systems as discussed elsewhere herein.

For example, DR6 knockouts offer an animal model to study DR6 function, the role of DR6 in development, and the role of DR6 in various cellular pathways and diseases, particularly motor neuron dysfunction disorders, e.g., ALS.

Provided herein are methods and compositions for the genetic modification of the DR6 locus in a non-human animal, cell, tissue or embryo.

The genetic modification of the DR6 locus can be any modification of the locus as described in detail elsewhere herein (i.e. deletion, insertion, replacement, etc.). In such cases the genetic modification results in loss-of-function of DR6. In one embodiment, the genetic modification comprises a disruption or a knockout of DR6.

A. Reporter Knock-in Allele Design and Construction

As a non-limiting example, a deletion start point may be set in the second exon to allow the insert nucleic acid to be operably linked to an endogenous signal sequence. FIG. 1 shows an example of a targeted deletion of all or most of the sequence coding DR6 and replacement with a cassette that contains a transmembrane domain sequence from the ROR1 (receptor tyrosine kinase-like orphan receptor 1) gene, a sequence from the *E. coli* lacZ gene that encodes β-galactosidase and a cassette (neo$^r$) that expresses neomycin phosphotransferase for the selection of G418-resistant ES cell colonies. LoxP recombinase recognition sites that enable Cre-mediated excision prior to phenotypic analysis flank the drug selection cassette.

LTVEC targeting vectors may be introduced into ES cells and screened for correctly targeted clones by the modification-of-allele assay (Frendewey, D., et al. (2010), Methods Enzymol 476, 295-307).

Various methods can be used to identify cells having a targeted modification, such as a deletion or an insertion. Such methods can comprise identifying one cell having the targeted modification at a target locus. Screening can be done to identify such cells with modified genomic loci.

The screening step can comprise a quantitative assay for assessing modification of allele (MOA) of a parental chromosome. For example, the quantitative assay can be carried out via a quantitative PCR, such as a real-time PCR (qPCR). The real-time PCR can utilize a first primer set that recognizes the target locus and a second primer set that recognizes a non-targeted reference locus. The primer set can comprise a fluorescent probe that recognizes the amplified sequence.

Other examples of suitable quantitative assays include fluorescence-mediated in situ hybridization (FISH), comparative genomic hybridization, isothermic DNA amplification, quantitative hybridization to an immobilized probe(s), Invader Probes®, MMP Assays®, TaqMan® Molecular Beacon, or Eclipse™ probe technology (see, e.g., US2005/0144655, which is incorporated by reference herein in its entirety).

The VelociMouse® method (Poueymirou, W. T., et al. (2007), Nat Biotechnol 25, 91-99) may be applied to 8-cell embryo stage injection to convert the targeted ES cells into fully ES cell-derived F0 generation heterozygous mice ready for lacZ expression profiling or breeding to homozygosity. Mice bearing ZEN-Ub1 cassette may be bred to a Cre deleter mouse strain (see, e.g., International Patent Application Publication No. WO 2009/114400) to remove any floxed neo$^r$ cassette.

Further details of the methods for generating DR6 reporter knock-in animals is provided in Example 1 herein.

B. Reporter Expression Profiling

As described elsewhere herein, the genetic modification of the DR6 locus can comprise a replacement of or an insertion/addition to the DR6 locus or a portion thereof with an insert nucleic acid. In some cases, the insert nucleic acid comprises a reporter gene. In one embodiment, the reporter gene is positioned in the DR6 locus in operable linkage with the endogenous DR6 promoter. Such a modification allows for the expression of the reporter gene driven by the endogenous DR6 promoter. Alternatively, the reporter gene is not placed in operable linkage with the endogenous DR6 promoter.

Any reporter (or detectable moiety) can be used in well-known methods and compositions. Non-liming examples of reporters include, for example, β-galactosidase (encoded by the lacZ gene), Green Fluorescent Protein (GFP), enhanced Green Fluorescent Protein (eGFP), mPlum, mCherry, tdTomato, mStrawberry, J-Red, DsRed, mOrange, mKO, mCitrine, Venus, YPet, enhanced yellow fluorescent protein (EYFP), Emerald, CyPet, cyan fluorescent protein (CFP), Cerulean, T-Sapphire, luciferase, alkaline phosphatase, or a combination thereof.

The methods and compositions described herein may be performed in the absence of a reporter gene or with any reporter gene. The following description is a non-limiting example utilizing a lacZ reporter gene that encodes for β-galactosidase.

C. Phenotypes

Genetic modification of the endogenous DR6 locus may result in various phenotypes in the non-human animals provided herein. In one embodiment, genetic modification of the endogenous DR6 locus results in non-human animals that are grossly normal at birth, but that develop ALS-like symptoms upon aging, e.g., after 1 week of age, after 2 weeks of age, after 3 weeks of age, after 4 weeks of age, after 5 weeks of age, after 6 weeks of age, after 7 weeks of age, after 8 weeks of age, etc. In another embodiment, genetic modification of the endogenous DR6 locus results in abnormal functions of one or more cell types, e.g., a neuron and/or a glial cell, and/or a portion thereof, e.g., myelin. A neuron includes a sensory neuron, a motor neuron, and all other neuronal types commonly referred to as an interneuron. Glial cell includes astrocytes, oligodendrocytes, etc.

The term "ALS-like symptom" or the like shall generally mean a "symptom associated with ALS," or a "symptom resulting from upper and/or lower motor neuron dysfunction." An ALS-like symptom may involve impairment neurons, e.g., motor neurons, sensory neurons, and/or interneurons. For example, an ALS-like symptom involving upper motor neurons may result in spasticity (e.g., spastic paralysis, rigidity), increased and/or abnormal reflexes (e.g., Babinski's sign), tremors and a combination thereof. An ALS-like symptom involving impairment of lower motor neurons may result in muscle weakness and wasting, fasciculations, and a combination thereof, and/or impairment of the bulbar resulting in an inability to swallow and tongue fasciculations. An ALS-like symptom may also comprise one or more of the following phenotypes: a) kyphosis; b) abnormal hind limb clasping, dragging or toe curling; c) deficiency in motor coordination and motor learning ability, deficiency in rotarod, catwalk and/or open field test(s); d) motor neuron loss in the spinal cord; e) astrocytosis in the spinal cord; f) weight loss compared with a control rodent; g) accumulation of poly-ubiquitinated proteins; (h) increased neurological scoring using the ALS-TDI neurological scoring system and/or (i) increased latency to respond to a painful stimulus.

ALS-TDI Neurological Scoring System

Score of 0: Full extension of hind legs away from lateral midline when mouse is suspended by its tail, and mouse can hold this for two seconds, suspended two to three times.

Score of 1: Collapse or partial collapse of leg extension towards lateral midline (weakness) or trembling of hind legs during tail suspension.

Score of 2: Toes curl under at least twice during walking of 12 inches, or any part of foot is dragging along cage bottom/table*.

Score of 3: Rigid paralysis or minimal joint movement, foot no being used for generating forward motion.

Score of 4: Mouse cannot right itself within 30 seconds after being placed on either side.

II. Methods for Modifying the Endogenous DR6 Locus in Non-Human Animals

Methods for genetically modifying the endogenous DR6 locus in non-human animals, cells, tissues or embryos are provided herein. In one embodiment, a method for modifying the DR6 locus in a pluripotent cell is provided. Such a method comprises (a) introducing into the pluripotent cell a targeting construct comprising an insert nucleic acid flanked with 5' and 3' homology arms that can undergo homologous recombination with the DR6 locus; and (b) identifying a modified pluripotent cell comprising a targeted genetic modification at the DR6 locus. In such methods, the genetic modification results in loss-of-function of the DR6. In one embodiment, the pluripotent cell is a rodent embryonic stem cell. In another embodiment, the pluripotent cell is a human iPS cell.

A. Targeting Vectors and Insert Nucleic Acids

Further provided are targeting vectors or targeting constructs to be employed in the methods for making the genetically modified non-human animals, cells, tissues or embryos provided herein.

In one embodiment, a targeting vector is provided that comprises an insert nucleic acid flanked by 5' and 3' homology arms that can undergo homologous recombination with an DR6 locus.

The targeting vectors and examples of components of the targeting vectors (i.e. insert nucleic acids, polynucleotides of interest, expression cassettes, etc.) are described in detail herein below.

i. Insert Nucleic Acid

The "insert nucleic acid" or "insert polynucleotide" comprises a segment of DNA that one desires to integrate at the target locus. In one embodiment, the insert nucleic acid comprises one or more polynucleotides of interest. In other embodiments, the insert nucleic acid can comprise one or more expression cassettes. A given expression cassette can comprise a polynucleotide of interest, a polynucleotide encoding a selection marker and/or a reporter gene along with the various regulatory components that influence expression.

Any polynucleotide of interest may be contained in the various insert polynucleotides and thereby integrated at the target genomic locus. The methods disclosed herein, provide for at least 1, 2, 3, 4, 5, 6 or more polynucleotides of interest to be integrated into the targeted DR6 genomic locus.

In one embodiment, the polynucleotide of interest contained in the insert nucleic acid encodes a reporter. In another embodiment, the polynucleotide of interest encodes for a selectable marker.

In one embodiment, the polynucleotide of interest can be flanked by site-specific recombination sites. In a specific embodiment, the site-specific recombination sites flank a segment encoding a reporter and/or a segment encoding a selectable marker.

Non-limiting examples of polynucleotides of interest, including selection markers and reporter genes that can be included within the insert nucleic acid are discussed in detail elsewhere herein.

The polynucleotide of interest within the insert polynucleotide when integrated at the target DR6 locus can introduce one or more genetic modifications into the cell. The genetic modification can comprise a deletion of an endogenous nucleic acid sequence and/or the addition of an exogenous or heterologous or orthologous polynucleotide into the target genomic locus. In one embodiment, the genetic modification comprises a replacement of an endogenous nucleic acid sequence with an exogenous polynucleotide of interest at the target genomic locus. Thus, methods provided herein allow for the generation of a genetic modification comprising a knockout, a deletion, an insertion, a replacement ("knock-in"), a point mutation, a domain swap, an exon swap, an intron swap, a regulatory sequence swap, a gene swap, or a combination thereof in a target DR6 locus. Such modifications may occur upon integration of the first, second, third, fourth, fifth, six, seventh, or any subsequent insert polynucleotides into the target genomic locus.

The polynucleotide of interest within the insert polynucleotide and/or integrated at the target genomic locus can comprise a sequence that is native or homologous to the cell it is introduced into; the polynucleotide of interest can be heterologous to the cell it is introduced to; the polynucleotide of interest can be exogenous to the cell it is introduced into; the polynucleotide of interest can be orthologous to the cell it is introduced into; or the polynucleotide of interest can be from a different species than the cell it is introduced into. The term "homologous" in reference to a sequence is a sequence that is native to the cell. The term "heterologous" in reference to a sequence is a sequence that originates from a foreign species, or, if from the same species, is substantially modified from its native form in composition and/or genomic locus by deliberate human intervention. The term "exogenous" in reference to a sequence is a sequence that originates from a foreign species. The term "orthologous" is a polynucleotide from one species that is functionally equivalent to a known reference sequence in another species (i.e., a species variant). The polynucleotide of interest can be from any organism of interest including, but not limited to, a prokaryote, a eukaryote, a non-human, a rodent, a hamster, a mouse, a rat, a human, a monkey, an avian, an agricultural mammal or a non-agricultural mammal. The polynucleotide of interest can further comprise a coding region, a non-coding region, a regulatory region, or a genomic DNA. Thus, the $1^{st}$, $2^{nd}$, $3^{rd}$, $4^{th}$, $5^{th}$, $6^{th}$, $7^{th}$, and/or any of the subsequent insert polynucleotides can comprise such sequences.

In one embodiment, the polynucleotide of interest can range from about 500 nucleotides to about 200 kb as described above. The polynucleotide of interest can be from about 500 nucleotides to about 5 kb, from about 5 kb to about 200 kb, from about 5 kb to about 10 kb, from about 10 kb to about 20 kb, from about 20 kb to about 30 kb, from about 30 kb to about 40 kb, from about 40 kb to about 50 kb, from about 60 kb to about 70 kb, from about 80 kb to about 90 kb, from about 90 kb to about 100 kb, from about 100 kb to about 110 kb, from about 120 kb to about 130 kb, from about 130 kb to about 140 kb, from about 140 kb to about 150 kb, from about 150 kb to about 160 kb, from about 160 kb to about 170 kb, from about 170 kb to about 180 kb, from about 180 kb to about 190 kb, or from about 190 kb to about 200 kb.

The polynucleotide of interest within the insert polynucleotide and/or inserted at the target genomic locus can encode a polypeptide, can encode an RNA, or it can comprise any regulatory regions or non-coding regions of interest including, for example, a regulatory sequence, a promoter sequence, an enhancer sequence, a transcriptional repressor-binding sequence, a Kozak consensus segment, a start codon, or a deletion of a non-protein-coding sequence, but does not comprise a deletion of a protein-coding sequence. In addition, the polynucleotide of interest within the insert polynucleotide and/or inserted at the target genomic locus can encode a protein expressed in the nervous system, the skeletal system, the digestive system, the circulatory system, the muscular system, the respiratory system, the cardiovascular system, the lymphatic system, the endocrine system, the urinary system, the reproductive system, or a combination thereof.

In one embodiment, the insert nucleic acid comprises a knock-in allele of at least one exon of an endogenous gene. In one embodiment, the insert nucleic acid comprises a knock-in allele of the entire endogenous gene (i.e., "gene-swap knock-in").

In one embodiment, the insert nucleic acid comprises a regulatory element, including for example, a promoter, an enhancer, or a transcriptional repressor-binding element.

In further embodiments, the insert nucleic acid comprises a conditional allele. In one embodiment, the conditional allele is a multifunctional allele, as described in US 2011/0104799, which is incorporated by reference in its entirety. In specific embodiments, the conditional allele comprises: (a) an actuating sequence in sense orientation with respect to transcription of a target gene, and a drug selection cassette in sense or antisense orientation; (b) in antisense orientation a nucleotide sequence of interest (NSI) and a conditional by inversion module (COIN, which utilizes an exon-splitting intron and an invertible genetrap-like module; see, for example, US 2011/0104799, which is incorporated by reference in its entirety); and (c) recombinable units that recombine upon exposure to a first recombinase to form a conditional allele that (i) lacks the actuating sequence and the DSC, and (ii) contains the NSI in sense orientation and the COIN in antisense orientation.

In one embodiment, the insert nucleic acid comprises a genetic modification in a coding sequence. In one embodiment, the genetic modification comprises a deletion mutation of a coding sequence. In one embodiment, the genetic modification comprises a fusion of two endogenous coding sequences.

In one embodiment, the genetic modification comprises a deletion of a non-protein-coding sequence, but does not comprise a deletion of a protein-coding sequence. In one embodiment, the deletion of the non-protein-coding sequence comprises a deletion of a DR6 locus or a portion thereof. In one embodiment, the deletion of the non-protein-coding sequence comprises a deletion of a regulatory element. In one embodiment, the genetic modification comprises a deletion of a promoter. In one embodiment, the genetic modification comprises an addition of a promoter or a regulatory element. In one embodiment, the genetic modification comprises a replacement of a promoter or a regulatory element.

In one embodiment, the nucleic acid sequence of the targeting vector can comprise a polynucleotide that when integrated into the genome will produce a genetic modification of a region of the mammalian, non-human animal, or a non-human mammalian DR6 locus, wherein the genetic modification at the DR6 locus results in a loss-of-function of the DR6. In one embodiment, a DR6 knockout ("null allele") is generated. In another embodiment, a disruption in the DR6 locus is generated.

In further embodiments, the insert nucleic acid results in the replacement of a portion of the mammalian, non-human animal, or non-human mammalian DR6 locus, with an insert nucleic acid sequence. In one embodiment, the insert nucleic acid sequence is a reporter nucleic acid sequence.

The given insert polynucleotide and the corresponding region of the mammalian, non-human, or non-human mammalian locus being replaced can be a non-coding region, a coding region, an intron, an exon, an untranslated region, a regulatory region, a promoter, or an enhancer or any combination thereof. Moreover, the given insert polynucleotide and/or the region of the mammalian, non-human, or non-human mammalian locus being deleted can be of any desired length, including for example, between 10-100 nucleotides in length, 100-500 nucleotides in length, 500-1 kb nucleotide in length, 1 kb to 1.5 kb nucleotide in length, 1.5 kb to 2 kb nucleotides in length, 2 kb to 2.5 kb nucleotides in length, 2.5 kb to 3 kb nucleotides in length, 3 kb to 5 kb nucleotides in length, 5 kb to 8 kb nucleotides in length, 8 kb to 10 kb nucleotides in length or more. In other instances, the size of the insertion or replacement is from about 5 kb to about 10 kb, from about 10 kb to about 20 kb, from about 20 kb to about 40 kb, from about 40 kb to about 60 kb. In other embodiments, the given insert polynucleotide and/or the region of the mammalian, human cell, or non-human mammalian locus being deleted is at least 100, 200, 300, 400, 500, 600, 700, 800, or 900 nucleotides or at least 1 kb, 2 kb, 3 kb, 4 kb, 5 kb, 6 kb, 7 kb, 8 kb, 9 kb, 10 kb, 11 kb, 12 kb, 13 kb, 14 kb, 15 kb, 16 kb, 17 kb, 18 kb, 19 kb, 20 kb, 25 kb, 30 kb, 35 kb, 40 kb, 45 kb, 50 kb or greater.

In one embodiment, the insert nucleic acid is inserted into the DR6 locus of interest such that it is operably linked to the endogenous DR6 promoter. In such cases, the DR6 promoter drives expression of the insert nucleic acid sequence. In one embodiment, the insert nucleic acid sequence is a reporter nucleic acid sequence.

In some cases, the insert nucleic acid comprises a promoter. In one embodiment, the insert nucleic acid comprises a polynucleotide of interest operably linked to a promoter that drives expression of the polynucleotide of interest. In one embodiment, the polynucleotide of interest comprises a reporter nucleic acid sequence. In another embodiment, the polynucleotide of interest comprises a selection marker nucleic acid sequence.

In one embodiment, the promoter is constitutively active promoter.

In one embodiment, the promoter is an inducible promoter. In one embodiment, the inducible promoter is a chemically-regulated promoter. In one embodiment, the chemically-regulated promoter is an alcohol-regulated promoter. In one embodiment, the alcohol-regulated promoter is an alcohol dehydrogenase (alcA) gene promoter. In one embodiment, the chemically-regulated promoter is a tetracycline-regulated promoter. In one embodiment, the tetracycline-regulated promoter is a tetracycline-responsive promoter. In one embodiment, the tetracycline-regulated promoter is a tetracycline operator sequence (tetO). In one embodiment, the tetracycline-regulated promoter is a tet-On promoter. In one embodiment, the tetracycline-regulated promoter a tet-Off promoter. In one embodiment, the chemically-regulated promoter is a steroid regulated promoter. In one embodiment, the steroid regulated promoter is a promoter of a rat glucocorticoid receptor. In one embodiment, the steroid regulated promoter is a promoter of an estrogen receptor. In one embodiment, the steroid-regulated promoter is a promoter of an ecdysone receptor. In one embodiment, the chemically-regulated promoter is a metal-regulated promoter. In one embodiment, the metal-regulated promoter is a metalloprotein promoter. In one embodiment, the inducible promoter is a physically-regulated promoter. In one embodiment, the physically-regulated promoter is a temperature-regulated promoter. In one embodiment, the temperature-regulated promoter is a heat shock promoter. In one embodiment, the physically-regulated promoter is a light-regulated promoter. In one embodiment, the light-regulated promoter is a light-inducible promoter. In one embodiment, the light-regulated promoter is a light-repressible promoter.

In one embodiment, the promoter is a tissue-specific promoter. In one embodiment, the promoter is a neuron-specific promoter. In one embodiment, the promoter is a glia-specific promoter. In one embodiment, the promoter is a muscle cell-specific promoter. In one embodiment, the promoter is a heart cell-specific promoter. In one embodiment, the promoter is a kidney cell-specific promoter. In one embodiment, the promoter is a bone cell-specific promoter. In one embodiment, the promoter is an endothelial cell-specific promoter. In one embodiment, the promoter is an immune cell-specific promoter. In one embodiment, the immune cell promoter is a B cell promoter. In one embodiment, the immune cell promoter is a T cell promoter.

In one embodiment, the promoter is a developmentally-regulated promoter. In one embodiment, the developmentally-regulated promoter is active only during an embryonic stage of development. In one embodiment, the developmentally-regulated promoter is active only in an adult cell.

In specific embodiments, the promoter may be selected based on the cell type. Thus the various promoters find use in a eukaryotic cell, a mammalian cell, a non-human mammalian cell, a pluripotent cell, a non-human pluripotent cell, a human pluripotent cell, a human ES cell, a human adult stem cell, a developmentally-restricted human progenitor cell, a human iPS cell, a human cell, a rodent cell, a rat cell, a mouse cell, a hamster cell, a fibroblast or a CHO cell.

In some embodiments, the insert nucleic acid comprises a nucleic acid flanked with site-specific recombination target sequences. It is recognized the while the entire insert nucleic acid can be flanked by such site-specific recombination target sequences, any region or individual polynucleotide of interest within the insert nucleic acid can also be flanked by such sites. The site-specific recombinase can be introduced into the cell by any means, including by introducing the recombinase polypeptide into the cell or by introducing a polynucleotide encoding the site-specific recombinase into the host cell. The polynucleotide encoding the site-specific recombinase can be located within the insert nucleic acid or within a separate polynucleotide. The site-specific recombinase can be operably linked to a promoter active in the cell including, for example, an inducible promoter, a promoter that is endogenous to the cell, a promoter that is heterologous to the cell, a cell-specific promoter, a tissue-specific promoter, or a developmental stage-specific promoter. Site-specific recombination target sequences, which can flank the insert nucleic acid or any polynucleotide of interest in the insert nucleic acid can include, but are not limited to, loxP, lox511, lox2272, lox66, lox71, loxM2, lox5171, FRT, FRT11, FRT71, attp, att, FRT, rox, or a combination thereof.

In some embodiments, the site-specific recombination sites flank a polynucleotide encoding a selection marker and/or a reporter gene contained within the insert nucleic acid. In such instances following integration of the insert nucleic acid at the targeted locus the sequences between the site-specific recombination sites can be removed.

In one embodiment, the insert nucleic acid comprises a polynucleotide encoding a selection marker. The selection marker can be contained in a selection cassette. Such selection markers include, but are not limited, to neomycin phosphotransferase ($neo^r$), hygromycin B phosphotransferase ($hyg^r$), puromycin-N-acetyltransferase ($puro^r$), blasticidin S deaminase ($bsr^r$), xanthine/guanine phosphoribosyl transferase (gpt), or herpes simplex virus thymidine kinase (HSV-k), or a combination thereof. In one embodiment, the polynucleotide encoding the selection marker is operably linked to a promoter active in the cell. In one embodiment, the polynucleotide encoding the selection marker is flanked with site-specific recombination target sequences.

The insert nucleic acid can further comprise a reporter gene operably linked to a promoter, wherein the reporter gene encodes a reporter protein selected from the group consisting of or comprising β-galactosidase (encoded by the lacZ gene), GFP, mPlum, mCherry, tdTomato, mStrawberry, J-Red, DsRed, mOrange, mKO, mCitrine, Venus, YPet, enhanced yellow fluorescent protein (EYFP), Emerald, enhanced green fluorescent protein (EGFP), CyPet, cyan fluorescent protein (CFP), Cerulean, T-Sapphire, luciferase, alkaline phosphatase, and/or a combination thereof. Such reporter genes can be operably linked to a promoter active in the cell. Such promoters can be an inducible promoter, a promoter that is endogenous to the reporter gene or the cell, a promoter that is heterologous to the reporter gene or to the cell, a cell-specific promoter, a tissue-specific promoter, or a developmental stage-specific promoter.

ii. Expression Cassettes

Provided herein are polynucleotides or nucleic acid molecules comprising the various components employed in a targeted genomic integration system provided herein for targeting a DR6 locus (i.e. any one of or any combination of nuclease agents, recognition sites, insert nucleic acids, polynucleotides of interest, reporter sequences, targeting vectors, selection markers, and other components).

The terms "polynucleotide," "polynucleotide sequence," "nucleic acid sequence," and "nucleic acid fragment" are used interchangeably herein. These terms encompass nucleotide sequences and the like. A polynucleotide may be a polymer of RNA or DNA that is single- or double-stranded, that optionally contains synthetic, non-natural or altered nucleotide bases. A polynucleotide in the form of a polymer of DNA may be comprised of one or more segments of cDNA, genomic DNA, synthetic DNA, or mixtures thereof. Polynucleotides can comprise deoxyribonucleotides and ribonucleotides include both naturally occurring molecules and synthetic analogues, and any combination these. The polynucleotides provided herein also encompass all forms of sequences including, but not limited to, single-stranded forms, double-stranded forms, hairpins, stem-and-loop structures, and the like.

Further provided are recombinant polynucleotides comprising the various components of the targeted genomic integration system for targeting a DR6 locus. The terms "recombinant polynucleotide" and "recombinant DNA construct" are used interchangeably herein. A recombinant construct comprises an artificial or heterologous combination of nucleic acid sequences, e.g., regulatory and coding sequences that are not found together in nature. In other embodiments, a recombinant construct may comprise regulatory sequences and coding sequences that are derived from different sources, or regulatory sequences and coding sequences derived from the same source, but arranged in a manner different than that found in nature. Such a construct may be used by itself or may be used in conjunction with a vector. If a vector is used, then the choice of vector is dependent upon the method that is used to transform the host cells as is well known to those skilled in the art. For example, a plasmid vector can be used. Genetic elements required to successfully transform, select, and propagate host cells comprising any of the isolated nucleic acid fragments provided herein are also provided. Screening may be accomplished by Southern analysis of DNA, Northern analysis of mRNA expression, immunoblotting analysis of protein expression, or phenotypic analysis, among others.

In specific embodiments, one or more of the components of the targeted genomic integration system for targeting a DR6 locus described herein can be provided in an expression cassette for expression in a prokaryotic cell, a eukaryotic cell, a bacterial, a yeast cell, or a mammalian cell or other organism or cell type of interest. The cassette can include 5' and 3' regulatory sequences operably linked to a polynucleotide provided herein. "Operably linked" comprises a relationship wherein the components operably linked function in their intended manner. For example, an operable linkage between a polynucleotide of interest and a regulatory sequence (i.e., a promoter) is a functional link that allows for expression of the polynucleotide of interest. Operably linked elements may be contiguous or non-contiguous. When used to refer to the joining of two protein coding regions, operably linked means that the coding regions are in the same reading frame. In another instance, a nucleic acid sequence encoding a protein may be operably linked to regulatory sequences (e.g., promoter, enhancer, silencer sequence, etc.) so as to retain proper transcriptional regulation. The cassette may additionally contain at least one additional polynucleotide of interest to be co-introduced into the organism. Alternatively, the additional polynucleotide of interest can be provided on multiple expression cassettes. Such an expression cassette is provided with a plurality of restriction sites and/or recombination sites for insertion of a recombinant polynucleotide to be under the transcriptional regulation of the regulatory regions. The expression cassette may additionally contain selection marker genes.

The expression cassette can include in the 5'-3' direction of transcription, a transcriptional and translational initiation region (i.e., a promoter), a recombinant polynucleotide provided herein, and a transcriptional and translational termination region (i.e., termination region) functional in mammalian cell or a host cell of interest. The regulatory regions (i.e., promoters, transcriptional regulatory regions, Kozak sequence, and translational termination regions) and/or a polynucleotide provided herein may be native/analogous to the host cell or to each other. Alternatively, the regulatory regions and/or a polynucleotide provided herein may be heterologous to the host cell or to each other. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide. Alternatively, the regulatory regions and/or a recombinant polynucleotide provided herein may be entirely synthetic.

The termination region may be native with the transcriptional initiation region, may be native with the operably linked recombinant polynucleotide, may be native with the host cell, or may be derived from another source (i.e., foreign or heterologous) to the promoter, the recombinant polynucleotide, the host cell, or any combination thereof.

In preparing the expression cassette, the various DNA fragments may be manipulated, so as to provide for the DNA sequences in the proper orientation. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the expression cassettes provided herein. The promoters can be selected based on the desired outcome. It is recognized that different applications can be enhanced by the use of different promoters in the expression cassettes to modulate the timing, location and/or level of expression of the polynucleotide of interest. Such expression constructs may also contain, if desired, a promoter regulatory region (e.g., one conferring inducible, constitutive, environmentally- or developmentally-regulated, or cell- or tissue-specific/selective expression), a transcription initiation start site, a Kozak consensus sequence, a ribosome binding site, an RNA processing signal, a transcription termination site, and/or a polyadenylation signal.

The expression cassette containing the polynucleotides provided herein can also comprise a selection marker gene for the selection of transformed cells. Selectable marker genes are utilized for the selection of transformed cells or tissues.

Where appropriate, the sequences employed in the methods and compositions (i.e., the polynucleotide of interest, the nuclease agent, etc.) may be optimized for increased expression in the cell. That is, the genes can be synthesized using codons preferred in a given cell of interest including, for example, mammalian-preferred codons, human-preferred codons, rodent-preferred codon, mouse-preferred codons, rat-preferred codons, hamster-preferred codons, etc. for improved expression.

The various methods and compositions provided herein can employ selection markers. Various selection markers can be used in the methods and compositions disclosed herein. Such selection markers can, for example, impart resistance to an antibiotic such as G418, hygromycin, blasticidin, neomycin, or puromycin. Such selection markers include neomycin phosphotransferase (neo$^r$), hygromycin B phosphotransferase (hyg$^r$), puromycin-N-acetyltransferase (puro$^r$), and blasticidin S deaminase (bsr$^r$). In still other embodiments, the selection marker is operably linked to an inducible promoter and the expression of the selection marker is toxic to the cell. Non-limiting examples of such selection markers include xanthine/guanine phosphoribosyl transferase (gpt), hahypoxanthine-guanine phosphoribosyltransferase (HGPRT) or herpes simplex virus thymidine kinase (HSV-TK). The polynucleotide encoding the selection markers are operably linked to a promoter active in the cell.

iii. Targeting Vectors

Targeting vectors are employed to introduce the insert nucleic acid into the DR6 locus of the eukaryotic, non-human, mammalian, non-human mammalian, human, rodent, mouse, rat or hamster nucleic acid. The targeting vector comprises the insert nucleic acid and further comprises a 5' and a 3' homology arm, which flank the insert nucleic acid. The homology arms, which flank the insert nucleic acid, correspond to regions within the target DR6 locus of the eukaryotic, non-human, mammalian, non-human mammalian, human, rodent, mouse, rat or hamster nucleic acid. For ease of reference, the corresponding cognate genomic regions within the targeted genomic locus are referred to as "target sites". For example, a targeting vector can comprise a first insert nucleic acid flanked by a first and a second homology arm complementary to a first and a second target site. As such, the targeting vector thereby aids in the integration of the insert nucleic acid into the target locus nucleic acid through a homologous recombination event that occurs between the homology arms and the complementary target sites within the genome of the cell.

In one embodiment, the target locus of the eukaryotic, mammalian, non-human mammalian, human, rodent, mouse or hamster nucleic acid comprises a first nucleic acid sequence that is complementary to the 5' homology arm and a second nucleic acid sequence that is complementary to the 3' homology arm. In one embodiment, the first and the second nucleic acid sequences are separated by at least 5 kb. In another embodiment, the first and the second nucleic acid sequences are separated by at least 1 kb but less than 50 kb. In one embodiment, the first and the second nucleic acid sequences are separated by at least 2 kb. In one embodiment, the first and the second nucleic acid sequences are separated by at least 3 kb, at least 4 kb, at least 5 kb, at least 6 kb, at least 7 kb, at least 8 kb, at least 9 kb, at least 10 kb, at least 15 kb, at least 20 kb, at least 30 kb, at least 40 kb, or at least 50 kb. In still further embodiments, the first and the second nucleic acid sequence is separated by at least 1 kb but less than 2 kb, at least 2 kb but less than 3 kb, at least 4 kb but less than 5 kb, at least 5 kb but less than 6 kb, at least 6 kb but less than 7 kb, at least 7 kb but less than 8 kb, at least about 8 kb but less than 9 kb, at least 9 kb but less than 10 kb, or at least 10 kb but less than 15 kb, at least about 15 kb but less than about 20 kb, at least about 20 kb but less than about 30 kb, or at least about 40 kb but less than about 50 kb.

A homology arm of the targeting vector can be of any length that is sufficient to promote a homologous recombination event with a corresponding target site, including for example, at least 5-10 kb, 5-15 kb, 10-20 kb, 20-30 kb, 30-40 kb, 40-50 kb, 50-60 kb, 60-70 kb, 70-80 kb, 80-90 kb, 90-100 kb, 100-110 kb, 110-120 kb, 120-130 kb, 130-140 kb, 140-150 kb, 150-160 kb, 160-170 kb, 170-180 kb, 180-190 kb, 190-200 kb in length or greater. As outlined in further detail below, large targeting vectors can employ targeting arms of greater length. In a specific embodiment, the sum total of the 5' homology arm and the 3' homology arm is at least 10 kb or the sum total of the 5' homology arm and the 3' homology arm is at least about 16 kb to about 100 kb or about 30 kb to about 100 kb. In other embodiments, the size of the sum total of the total of the 5' and 3' homology arms of the LTVEC is about 10 kb to about 150 kb, about 10 kb to about 100 kb, about 10 kb to about 75 kb, about 20 kb to about 150 kb, about 20 kb to about 100 kb, about 20 kb to about 75 kb, about 30 kb to about 150 kb, about 30 kb to about 100 kb, about 30 kb to about 75 kb, about 40 kb to about 150 kb, about 40 kb to about 100 kb, about 40 kb to about 75 kb, about 50 kb to about 150 kb, about 50 kb to about 100 kb, or about 50 kb to about 75 kb, about 10 kb to about 30 kb, about 20 kb to about 40 kb, about 40 kb to about 60 kb, about 60 kb to about 80 kb, about 80 kb to about 100 kb, about 100 kb to about 120 kb, or from about 120 kb to about 150 kb. In one embodiment, the size of the deletion is the same or similar to the size of the sum total of the 5' and 3' homology arms of the LTVEC.

A homology arm and a target site (i.e., cognate genomic region) "complement" or are "complementary" to one another when the two regions share a sufficient level of sequence identity to one another to act as substrates for a homologous recombination reaction. By "homology" is meant DNA sequences that are either identical or share sequence identity to a corresponding or "complementary" sequence. The sequence identity between a given target site and the corresponding homology arm found on the targeting vector can be any degree of sequence identity that allows for homologous recombination to occur. For example, the amount of sequence identity shared by the homology arm of the targeting vector (or a fragment thereof) and the target site (or a fragment thereof) can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination. Moreover, a complementary region of homology between the homology arm and the complementary target site can be of any length that is sufficient to promote homologous recombination at the cleaved recognition site. For example, a given homology arm and/or complementary target site can comprise complementary regions of homology that are at least 5-10 kb, 5-15 kb, 10-20 kb, 20-30 kb, 30-40 kb, 40-50 kb, 50-60 kb, 60-70 kb, 70-80 kb, 80-90 kb, 90-100 kb, 100-110 kb, 110-120 kb, 120-130 kb, 130-140 kb, 140-150 kb, 150-160 kb, 160-170 kb, 170-180 kb, 180-190 kb, 190-200 kb, 200 kb to 300 kb in length or greater (such as described in the LTVEC vectors described elsewhere herein) such that the homology arm has sufficient homology to undergo homologous recombination with the corresponding target sites within the genome of the cell. For ease of reference the homology arms are referred to herein as a 5' and a 3' homology arm. This terminology relates to the relative position of the homology arms to the insert nucleic acid within the targeting vector.

The homology arms of the targeting vector are therefore designed to be complementary to a target site with the targeted locus. Thus, the homology arms can be complementary to a locus that is native to the cell, or alternatively they can be complementary to a region of a heterologous or exogenous segment of DNA that was integrated into the genome of the cell, including, but not limited to, transgenes, expression cassettes, or heterologous or exogenous regions of genomic DNA. Alternatively, the homology arms of the targeting vector can be complementary to a region of a human artificial chromosome or any other engineered genomic region contained in an appropriate host cell. Still further, the homology arms of the targeting vector can be complementary to or be derived from a region of a BAC library, a cosmid library, or a P1 phage library. Thus, in specific embodiments, the homology arms of the targeting vector are complementary to a eukaryotic, non-human, mammalian, non-human mammalian, human, rodent, mouse or rat genomic locus that is native, heterologous or exogenous to a given cell. In one embodiment, the homology arms are derived from a synthetic DNA.

The targeting vector (such as a large targeting vector) can also comprise a selection cassette or a reporter gene as discussed elsewhere herein. The selection cassette can comprise a nucleic acid sequence encoding a selection marker, wherein the nucleic acid sequence is operably linked to a promoter as discussed elsewhere herein. The selection marker and/or the reporter gene of the targeting vector can be flanked by the 5' and 3' homology arms or found either 5' or 3' to the homology arms.

In one embodiment, a targeting vector comprises an insert nucleic acid comprising a first nucleotide sequence that encodes a reporter. In some cases, following the homologous recombination with the DR6 locus, the first nucleotide sequence that encodes the reporter is operably linked to an endogenous promoter that drives expression of a DR6 at the DR6 locus.

In another embodiment, a targeting vector comprises an insert nucleic acid comprising a first nucleotide sequence that encodes a transmembrane domain operably linked with a second nucleotide sequence that encodes a reporter. In some cases, following the homologous recombination with the DR6 locus, the first nucleotide sequence that encodes the transmembrane domain is operably linked to an endogenous DR6 signal sequence that drives the destination of the transmembrane domain and reporter.

In another embodiment, the insert nucleic acid of the targeting vector comprises an additional nucleotide sequence that encodes a selectable marker. In some cases, the additional nucleic acid is operably linked to a promoter.

In one embodiment, the first and/or additional nucleotide sequence of the insert nucleic acid comprises a Kozak consensus sequence.

In one embodiment, the targeting vector (such as a large targeting vector) comprises a reporter gene and/or a selectable marker gene operably linked to a promoter as described elsewhere herein. Such reporter genes and/or selectable marker genes can be operably linked to a promoter active in the cell as described elsewhere herein.

In one embodiment, the targeting vector comprises a site-specific recombinase gene. In one embodiment, the site-specific recombinase gene encodes a Cre recombinase. In one embodiment, the Cre recombinase gene is Crei, wherein two exons encoding the Cre recombinase are separated by an intron to prevent its expression in a prokaryotic cell. In one embodiment, the site-specific recombinase gene encodes a Dre recombinase.

In one embodiment, the Cre recombinase gene further comprises a nuclear localization signal to facilitate localization of Cre (or any recombinase or nuclease agent) to the nucleus (e.g., the gene is an NLS-Cre gene). In a specific embodiment, the Cre recombinase gene further comprises a nuclear localization signal (NLS) and an intron (e.g., NLS-Crei).

In various embodiments, a suitable promoter for expression of the Cre or Crei recombinase discussed above is selected from or comprises a Prm1, Blimp1, Gata6, Gata4, Igf2, Lhx2, Lhx5, and/or Pax3. In a specific embodiment, the promoter is the Gata6 or Gata4 promoter. The various promoters can be from any organism, including for example, a rodent such as a mouse or a rat, a eukaryote, a non-human mammal, a mammal, a human or a hamster. In another specific embodiment, the promoter is a Prm1 promoter. In another specific embodiment, the promoter is a mouse Prm1 promoter. In another specific embodiment, the promoter is a Blimp1 promoter or a fragment thereof, e.g., a 1 kb or 2 kb fragment of a Blimp1 promoter. See, for example, U.S. Pat. Nos. 8,697,851, 9,267,152, 9,096,870, 8,354,389, 8,946,505, 8,946,504, 8,518,392, each of which is herein incorporated by reference in its entirety.

In one embodiment, the insert nucleic acid comprises a nucleotide sequence flanked by two site-specific recombination sites. Examples of site-specific recombination sites include, but are not limited to, loxP, lox511, lox2272, lox66, lox71, loxM2, lox5171, FRT, FRT11, FRT71, attp, att, FRT, rox, and a combination thereof.

iv. Large Targeting Vectors

The term "large targeting vector" or "LTVEC" includes large targeting vectors that comprise homology arms that correspond to and are derived from nucleic acid sequences larger than those typically used by other approaches intended to perform homologous targeting in cells and/or comprising insert polynucleotides comprising nucleic acid sequences larger than those typically used by other approaches intended to perform homologous recombination targeting in cells. In specific embodiments, the homology arms and/or the insert polynucleotide of the LTVEC comprises a genomic sequence of a eukaryotic cell. The size of the LTVEC is too large to enable screening of targeting events by conventional assays, e.g., southern blotting and long-range (e.g., 1 kb-5 kb) PCR. Examples of the LTVEC, include, but are not limited to, vectors derived from a bacterial artificial chromosome (BAC), a human artificial chromosome or a yeast artificial chromosome (YAC). Non-limiting examples of LTVECs and methods for making them are described, e.g., in U.S. Pat. Nos. 6,586,251, 6,596,541, 7,105,348, and WO 2002/036789 (PCT/US01/45375), each of which is herein incorporated by reference.

The LTVEC can be of any length, including, but not limited to, at least about 10 kb, about 15 kb, about 20 kb, about 30 kb, about 40 kb, about 50 kb, about 60 kb, about 70 kb, about 80 kb, about 90 kb, about 100 kb, about 150 kb, about 200 kb, from about 10 kb to about 15 kb, about 15 kb to about 20 kb, about 20 kb to about 30 kb, from about 30 kb to about 50 kb, from about 50 kb to about 300 kb, from about 50 kb to about 75 kb, from about 75 kb to about 100 kb, from about 100 kb to 125 kb, from about 125 kb to about 150 kb, from about 150 kb to about 175 kb, about 175 kb to about 200 kb, from about 200 kb to about 225 kb, from about 225 kb to about 250 kb, from about 250 kb to about 275 kb or from about 275 kb to about 300 kb.

In one embodiment, the homology arms of the LTVEC are derived from a BAC library, a cosmid library, or a P1 phage library. In other embodiments, the homology arms are derived from the targeted DR6 genomic locus of the cell and in some instances the target genomic locus that the LTVEC is designed to target is not targetable using a conventional method. In still other embodiments, the homology arms are derived from a synthetic DNA.

In one embodiment, a sum total of the upstream homology arm and the downstream homology arm in the LTVEC is at least 10 kb. In other embodiments, the upstream homology arm ranges from about 5 kb to about 100 kb. In one embodiment, the downstream homology arm ranges from about 5 kb to about 100 kb. In other embodiments, the sum total of the upstream and downstream homology arms are from about 5 kb to about 10 kb, from about 10 kb to about 20 kb, from about 20 kb to about 30 kb, from about 30 kb to about 40 kb, from about 40 kb to about 50 kb, from about 50 kb to about 60 kb, from about 60 kb to about 70 kb, from about 70 kb to about 80 kb, from about 80 kb to about 90 kb, from about 90 kb to about 100 kb, from about 100 kb to about 110 kb, from about 110 kb to about 120 kb, from about 120 kb to about 130 kb, from about 130 kb to about 140 kb, from about 140 kb to about 150 kb, from about 150 kb to about 160 kb, from about 160 kb to about 170 kb, from about 170 kb to about 180 kb, from about 180 kb to about 190 kb, or from about 190 kb to about 200 kb. In one embodiment, the size of the deletion is the same or similar to the size of the sum total of the 5' and 3' homology arms of the LTVEC.

In one embodiment, the LTVEC comprises a selection cassette or a reporter gene as discussed elsewhere herein.

III. Methods of Introducing Sequences and Generation of Transgenic Animals

As outlined above, methods and compositions are provided herein to allow for the targeted genetic modification of a DR6 locus. It is further recognized that additional targeted genetic modification can be made. Such systems that allow for these targeted genetic modifications can employ a variety of components and for ease of reference, herein the term "targeted genomic integration system" generically includes all the components required for an integration event (i.e. the various nuclease agents, recognition sites, insert DNA polynucleotides, targeting vectors, target genomic locus, and polynucleotides of interest).

The methods provided herein comprise introducing into a cell one or more polynucleotides or polypeptide constructs comprising the various components of the targeted genomic integration system. "Introducing" means presenting to the cell the sequence (polypeptide or polynucleotide) in such a manner that the sequence gains access to the interior of the cell. The methods provided herein do not depend on a particular method for introducing any component of the targeted genomic integration system into the cell, only that the polynucleotide gains access to the interior of a least one cell. Methods for introducing polynucleotides into various cell types are known in the art and include, but are not limited to, stable transfection methods, transient transfection methods, and virus-mediated methods.

In some embodiments, the cells employed in the methods and compositions have a DNA construct stably incorporated into their genome. "Stably incorporated" or "stably introduced" means the introduction of a polynucleotide into the cell such that the nucleotide sequence integrates into the genome of the cell and is capable of being inherited by progeny thereof. Any protocol may be used for the stable incorporation of the DNA constructs or the various components of the targeted genomic integration system.

Transfection protocols as well as protocols for introducing polypeptides or polynucleotide sequences into cells may vary. Non-limiting transfection methods include chemical-based transfection methods include the use of liposomes; nanoparticles; calcium phosphate (Graham et al. (1973). *Virology* 52 (2): 456-67, Bacchetti et al. (1977) *Proc Natl*

*Acad Sci USA* 74 (4): 1590-4 and, Kriegler, M (1991). *Transfer and Expression: A Laboratory Manual*. New York: W. H. Freeman and Company. pp. 96-97); dendrimers; or cationic polymers such as DEAE-dextran or polyethylenimine. Non chemical methods include electroporation; Sono-poration; and optical transfection. Particle-based transfections include the use of a gene gun, magnet assisted transfection (Bertram, J. (2006) *Current Pharmaceutical Biotechnology* 7, 277-28). Viral methods can also be used for transfection.

Non-human animals can be generated employing the various methods disclosed herein. Such methods comprises (1) integrating one or more polynucleotide of interest at the target DR6 genomic locus of interest of a pluripotent cell of the non-human animal to generate a genetically modified pluripotent cell comprising the insert polynucleotide in the targeted DR6 genomic locus employing the methods disclosed herein; (2) selecting the genetically modified pluripotent cell having the one or more polynucleotides of interest at the target DR6 genomic locus; (3) introducing the genetically modified pluripotent cell into a host embryo of the non-human animal, e.g., at a pre-morula stage; and (4) implanting the host embryo comprising the genetically modified pluripotent cell into a surrogate mother to generate an F0 generation derived from the genetically modified pluripotent cell. Similar methods can be employed to target a challenging target chromosomal locus. The non-human animal can be a non-human mammal, a rodent, a mouse, a rat, a hamster, a monkey, an agricultural mammal or a domestic mammal, or a fish or a bird.

The pluripotent cell can be a human ES cell, a non-human ES cell, a rodent ES cell, a mouse ES cell, a rat ES cell, a hamster ES cell, a monkey ES cell, an agricultural mammal ES cell or a domesticated mammal ES cell. In other embodiments, the pluripotent cell is a non-human cell, a mammalian cell, a human cell, a non-human mammalian cell, a human pluripotent cell, a human ES cell, a human adult stem cell, a developmentally-restricted human progenitor cell, a human iPS cell, a rodent cell, a rat cell, a mouse cell, a hamster cell. In one embodiment, the targeted genetic modification results in the loss-of-function of the DR6.

A mouse pluripotent cell, totipotent cell, or host embryo can be from any strain of mouse including, for example, inbred strains, hybrid strains, and outbred strains. Examples of mouse strains include a 129 strain, a C57BL strain (e.g., a C57BL/6 strain), a mix of 129 and C57BL/6 (e.g., 50% 129 and 50% C57BL/6), a BALB/c strain, and a Swiss Webster strain. Examples of 129 strains include 129P1, 129P2, 129P3, 129X1, 129S1 (e.g., 129S1/SV, 129S1/SvIm), 129S2, 129S4, 129S5, 129S9/SvEvH, 129S6 (129/SvEvTac), 129S7, 129S8, 129T1, and 129T2 (see, e.g., Festing et al. (1999) Revised nomenclature for strain 129 mice, Mammalian Genome 10:836). Examples of C57BL strains include C57BL/A, C57BL/An, C57BL/GrFa, C57BL/KaLwN, C57BL/6, C57BL/6J, C57BL/6ByJ, C57BL/6NJ, C57BL/10, C57BL/10ScSn, C57BL/10Cr, and C57BL/01a. Mice can be mixes of an aforementioned 129 strain (e.g., a 129S6 (129/SvEvTac) strain) and an aforementioned C57BL/6 strain, mixes of one or more aforementioned 129 strains, or mixes of one or more aforementioned C57BL strains. Mice can also be from a strain excluding 129 strains.

A rat pluripotent cell, totipotent cell, or host embryo can be from any rat strain, including, for example, inbred strains, hybrid strains, and outbred strains. Examples of rat strains include an ACI rat strain, a Dark Agouti (DA) rat strain, a Wistar rat strain, a LEA rat strain, a Sprague Dawley (SD) rat strain, or a Fischer rat strain such as Fisher F344 or Fisher F6. Rat pluripotent cells, totipotent cells, or host embryos can also be obtained from a strain derived from a mix of two or more strains recited above. For example, the rat pluripotent cell, totipotent cell, or host embryo can be derived from a strain selected from a DA strain and an ACI strain. The ACI rat strain is characterized as having black agouti, with white belly and feet and an $RT1^{av1}$ haplotype. Such strains are available from a variety of sources including Harlan Laboratories. An example of a rat ES cell line from an ACI rat is the ACI.G1 rat ES cell. The Dark Agouti (DA) rat strain is characterized as having an agouti coat and an $RT1^{av1}$ haplotype. Such rats are available from a variety of sources including Charles River and Harlan Laboratories. Examples of a rat ES cell line from a DA rat and are the DA.2B rat ES cell line or the DA.2C rat ES cell line. Other examples of rat strains are provided, for example, in US 2014/0235933, US 2014/0310828, and US 2014/0309487, each of which is herein incorporated by reference in its entirety for all purposes.

For example, germline-transmittable rat ES cells can be obtained by culturing isolated rat ES cells on a feeder cell layer with a medium comprising N2 supplement, B27 supplement, about 50 U/mL to about 150 U/mL leukemia inhibitory factor (LIF), and a combination of inhibitors consisting of a MEK inhibitor and a GSK3 inhibitor, wherein the feeder cell layer is not modified to express LIF, and wherein the rat ES cells: (i) have been modified to comprise a targeted genetic modification comprising at least one insertion of a heterologous polynucleotide comprising a selection marker into the genome of the rat ES cells and are capable of transmitting the targeted genetic modification through the germline; (ii) have a normal karyotype; (iii) lack expression of c-Myc; and (iv) form spherical, free-floating colonies in culture (See, for example, US 2014-0235933 A1 and US 2014-0310828 A1, each of which is incorporated by reference in its entirety). Other examples of derivation of rat embryonic stem cells and targeted modification are provided, e.g., in Yamamoto et al. ("Derivation of rat embryonic stem cells and generation of protease-activated receptor-2 knockout rats," Transgenic Res. 21:743-755, 2012) and Kwamata and Ochiya ("Generation of genetically modified rats from embryonic stem cells," Proc. Natl. Acad. Sci. USA 107(32):14223-14228, 2010).

Nuclear transfer techniques can also be used to generate the non-human animals. Briefly, methods for nuclear transfer include the steps of: (1) enucleating an oocyte; (2) isolating a donor cell or nucleus to be combined with the enucleated oocyte; (3) inserting the cell or nucleus into the enucleated oocyte to form a reconstituted cell; (4) implanting the reconstituted cell into the womb of an animal to form an embryo; and (5) allowing the embryo to develop. In such methods oocytes are generally retrieved from deceased animals, although they may be isolated also from either oviducts and/or ovaries of live animals. Oocytes can be matured in a variety of medium known to those of ordinary skill in the art prior to enucleation. Enucleation of the oocyte can be performed in a number of manners well known to those of ordinary skill in the art. Insertion of the donor cell or nucleus into the enucleated oocyte to form a reconstituted cell is usually by microinjection of a donor cell under the zona pellucida prior to fusion. Fusion may be induced by application of a DC electrical pulse across the contact/fusion plane (electrofusion), by exposure of the cells to fusion-promoting chemicals, such as polyethylene glycol, or by way of an inactivated virus, such as the Sendai virus. A reconstituted cell is typically activated by electrical and/or non-electrical means before, during, and/or after fusion of the nuclear donor and recipient oocyte. Activation methods include electric pulses, chemically induced shock, penetration by sperm, increasing levels of divalent cations in the oocyte, and reducing phosphorylation of cellular proteins (as by way of kinase inhibitors) in the oocyte. The activated reconstituted cells, or embryos, are typically cultured in medium well known to those of ordinary skill in the art and then transferred to the womb of an animal. See, for example, US20080092249, WO/1999/005266A2, US20040177390, WO/2008/017234A1, and U.S. Pat. No. 7,612,250, each of which is herein incorporated by reference.

Other methods for making a non-human animal comprising in its germline one or more genetic modifications as described herein is provided, comprising: (a) modifying a targeted genomic DR6 locus of a non-human animal in a prokaryotic cell employing the various methods described herein; (b) selecting a modified prokaryotic cell comprising the genetic modification at the targeted genomic locus; (c) isolating the genetically modified targeting vector from the genome of the modified prokaryotic cell; (d) introducing the genetically modified targeting vector into a pluripotent cell of the non-human animal to generate a genetically modified pluripotent cell comprising the insert nucleic acid at the targeted DR6 genomic locus; (e) selecting the genetically modified pluripotent cell; (f) introducing the genetically modified pluripotent cell into a host embryo of the non-human animal at a pre-morula stage; and (g) implanting the host embryo comprising the genetically modified pluripotent cell into a surrogate mother to generate an F0 generation derived from the genetically modified pluripotent cell. In such methods the targeting vector can comprise a large targeting vector. The non-human animal can be a non-human mammal, a rodent, a mouse, a rat, a hamster, a monkey, an agricultural mammal or a domestic mammal. The pluripotent cell can be a human ES cell, a non-human ES cell, a rodent ES cell, a mouse ES cell, a rat ES cell, a hamster ES cell, a monkey ES cell, an agricultural mammal ES cell or a domestic mammal ES cell. In other embodiments, the pluripotent cell is a non-human cell, a mammalian cell, a human cell, a non-human mammalian cell, a human pluripotent cell, a human ES cell, a human adult stem cell, a developmentally-restricted human progenitor cell, a human iPS cell, a human cell, a rodent cell, a rat cell, a mouse cell, a hamster cell. In one embodiment, the targeted genetic modification results in the loss-of-function of the DR6.

In further methods, the isolating step (c) further comprises (c1) linearizing the genetically modified targeting vector (i.e., the genetically modified LTVEC). In still further embodiments, the introducing step (d) further comprises (d1) introducing a nuclease agent into the pluripotent cell to facilitate homologous recombination. In one embodiment, selecting steps (b) and/or (e) are carried out by applying a selectable agent as described herein to the prokaryotic cell or the pluripotent cell. In one embodiment, selecting steps (b) and/or (e) are carried out via a modification of allele (MOA) assay as described herein.

In some embodiments, various genetic modifications of the target genomic loci described herein can be carried out by a series of homologous recombination reactions (BHR) in bacterial cells using an LTVEC derived from Bacterial Artificial Chromosome (BAC) DNA using VELOCIGENE® genetic engineering technology (see, e.g., U.S. Pat. No. 6,586,251 and Valenzuela, D. M. et al. (2003), *Nature Biotechnology* 21(6): 652-659, which is incorporated herein by reference in their entireties).

In some embodiments, the DR6 targeted pluripotent and/or totipotent cells comprising various genetic modifications as described herein are used as insert donor cells and introduced into a pre-morula stage embryo from a corresponding organism, e.g., an 8-cell stage mouse embryo, via the VELOCIMOUSE® method (see, e.g., U.S. Pat. Nos. 7,576,259, 7,659,442, 7,294,754, and US 2008-0078000 A1, all of which are incorporated by reference herein in their entireties). The non-human animal embryo comprising the genetically modified pluripotent and/or totipotent cells is incubated until the blastocyst stage and then implanted into a surrogate mother to produce an F0 generation. In some embodiments, targeted mammalian ES cells comprising various genetic modifications as described herein are introduced into a blastocyst stage embryo. Non-human animals bearing the genetically modified genomic locus (i.e. a DR6 locus) can be identified via modification of allele (MOA) assay as described herein. The resulting F0 generation non-human animal derived from the genetically modified pluripotent and/or totipotent cells is crossed to a wild-type non-human animal to obtain F1 generation offspring. Following genotyping with specific primers and/or probes, F1 non-human animals that are heterozygous for the genetically modified genomic locus are crossed to each other to produce F2 generation non-human animal offspring that are homozygous for the genetically modified genomic locus.

In one embodiment, a method for making a non-human animal comprising a genetic modification in at least one DR6 locus is provided. Such a method comprising: (a) contacting a pluripotent cell with a targeting construct comprising an insert nucleic acid flanked by 5' and 3' homology arms; wherein the targeting construct undergoes homologous recombination with the DR6 locus in a genome of the cell to form a modified pluripotent cell; (b) introducing the modified pluripotent cell into a host embryo; and (c) gestating the host embryo in a surrogate mother, wherein the surrogate mother produces progeny comprising a modified DR6 locus, wherein said genetic modification results in loss-of-function of at least one DR6.

IV. Cells

The various methods described herein employ a genomic locus targeting system for modifying a DR6 locus in a cell. Such cells include prokaryotic cells such as bacterial cells including *E. coli*, or eukaryotic cells such as yeast, insect, amphibian, plant, or mammalian cells, including, but not limited to a mouse cell, a rat cell, a hamster cell, a rabbit cell, a pig cell, a bovine cell, a deer cell, a sheep cell, a goat cell, a chicken cell, a cat cell, a dog cell, a ferret cell, a primate (e.g., marmoset, rhesus monkey) cell, and the like and cells from domesticated mammals or cells from agricultural mammals. Some cells are non-human, particularly non-human mammalian cells. In some embodiments, for those mammals for which suitable genetically modifiable pluripotent cells are not readily available, other methods are employed to reprogram somatic cells into pluripotent cells, e.g., via introduction into somatic cells of a combination of pluripotency-inducing factors, including, but not limited to, Oct3/4, Sox2, KLF4, Myc, Nanog, LIN28, and Glis1. In such methods, the cell can also be a mammalian cell, human cell, a non-human mammalian cell, a non-human cell, a cell from a rodent, a rat, a mouse, a hamster, a fibroblast cell or any other host cell. In other embodiments, the cell is a pluripotent cell, an induced pluripotent stem (iPS) cell, a non-human embryonic stem (ES) cell. Such cells include pluripotent cells, including, for example, induced pluripotent stem (iPS) cells, human iPS cells, mouse embryonic stem (ES) cells, rat embryonic stem (ES) cells, human embryonic (ES) cells, or developmentally restricted human progenitor cells, a rodent embryonic stem (ES) cell, a mouse embryonic stem (ES) cell or a rat embryonic stem (ES) cell.

V. Animal Models

Also provided herein is a method of identifying a candidate agent for treating, preventing and/or inhibiting ALS. In a specific embodiment, the inhibitory effect of the substance is determined in vivo, by administering the agent to an animal that has a DR6 loss of function, phenotypically normal at birth, and develops ALS-like symptoms after 8 weeks of age.

The animals may be administered with the agent to be tested by any convenient route, for example by systemic injection, pumps for long-term exposure, or direct intracerebral injection. These animals may be included in a behavior study, so as to determine the effect of the substance on the behavior, e.g., motor behavior, of the animals compared to appropriate control animals that did not receive the agent. A biopsy or anatomical evaluation of animal spinal cord, muscle and/or brain tissue may also be performed, and/or a sample of blood or CSF may be collected.

While the invention has been particularly shown and described with reference to a number of embodiments, it would be understood by those skilled in the art that changes in the form and details may be made to the various embodiments disclosed herein without departing from the spirit and scope of the invention and that the various embodiments disclosed herein are not intended to act as limitations on the scope of the claims.

EXAMPLES

The following examples are provided for illustrative purposes only and are not intended to limit the scope of the invention.

Example 1: Genetic Modification of a DR6 (Tnfrs21) Locus

VelociGene® methods were employed, as described previously, which allows for the rapid and high-throughput generation of custom gene mutations in mice (Valenzuela, D. M., et al. (2003b), *Nat Biotechnol* 21:652-659). Briefly, large targeting vectors (LTVEC) were generated using BAC clones from the mouse bMQ (12957/SvEv Brd-Hprt b-m2) or RP23 BAC library (Adams, D. J., et al. (2005), *Genomics* 86:753-758). The lacZ/neo$^r$ reporter/selection cassette (FIG. 1) was identical to the ZEN-Ub1 cassette used for the NIH KOMP (sequence available via internet on the World Wide Web (www) at the URL "www.velocigene.com/komp/detail/10020") except that the amino-terminal end of the β-galactosidase coding sequence in the lacZ part was modified to include transmembrane domain from ROR1.

An LTVEC was introduced into C57BL/6NTac ES cells (Poueymirou et al. (2007); Valenzuela et al. (2003a)) with a multi-well electroporation device (Harvard Apparatus, Boston, Mass.) in electroporation buffer (Millipore) 3.3×10$^6$ cells, 0.67 µg DNA in a volume of 0.125 ml followed by culturing on 15 cm gelatinized plates. Selection medium containing G418 was added 48 hours after electroporation and changed daily thereafter. Drug-resistant colonies were picked 10 days after electroporation, treated with trypsin and cultured in gelatinized 96-well plates for at least three days before DNA extraction and purification. Correctly targeted ES cell clones were identified by the modification-of-allele (MOA) assay (Frendewey et al. (2010), *Methods in enzymology* 476:295-307; Valenzuela et al. (2003a), *Nat. Biotechnol.* 21:652-659).

The VelociMouse® method (Dechiara, T. M., (2009), *Methods Mol Biol* 530:311-324; Poueymirou et al. (2007), *Nat. Biotechnol.* 25:91-99) was used, in which targeted ES cells were injected into uncompacted 8-cell stage Swiss Webster embryos to produce fully ES cell-derived F0 generation mice carrying the DR6 knockout mutations. Male VelociMice® were used directly for lacZ expression profiling or mated with C57BL/129 females to produce embryos or adults for lacZ analysis or to produce F1 breeders and phenotypic studies were performed on N2F1 mice. Timed matings were carried out by assigning the morning of identification of vaginal plugs as day 0.5 (E0.5).

Example 2: Phenotypic Analysis of Animals Comprising a Mutation in a DR6 Locus

Phenotypic studies of N2F1 mice began at 6-8 weeks of age. For timed matings, we assigned the morning of identification of vaginal plugs as embryonic day 0.5 (E0.5). DR6 KO and wild-type littermates were observed from birth for various developmental milestones (running, breathing, facial and limb abnormalities, skin color, posture, righting and eye opening) until about 6-8 weeks of age, when they were housed in 12 h of light per day at 69-74 F, and 40-60% humidity for study. All experiments began at 6-9 weeks of age and all animal procedures were conducted in compliance with protocols approved by the Regeneron Pharmaceuticals Institutional Animal Care and Use Committee.

Analysis of the motor impairment was conducted using rotarod testing, open field locomotor testing, and catwalk testing. During catwalk testing, subjects walk across an illuminated glass platform while a video camera records from below. Gait related parameters—such as stride pattern, individual paw swing speed, stance duration, and pressure—are reported for each animal. This test is used to phenotype transgenic strains of mice and evaluate novel chemical entities for their effect on motor performance. CatWalk XT is a system for quantitative assessment of footfalls and gait in rats and mice. It is used to evaluate the locomotor ability of rodents in almost any kind of experimental model of central nervous, peripheral nervous, muscular, or skeletal abnormality.

Upper motor neuron impairment presents as spasticity (i.e., rigidity), increased reflexes, tremor, bradykinesia, and Babinski signs. Lower motor neuron impairment presents as muscle weakness, wasting, clasping, curling and dragging of feet, and fasciculations. Bulbar impairment presents as difficulty swallowing, slurring and tongue fasciculations. Table 2 provides the scoring methodology related to motor impairment, tremor and rigidity of animals during testing. Assessment of overall motor function was performed using blinded subjective scoring assays, and all data is reported as mean+/− SEM.

TABLE 2

|  | 0 | 1 | 2 | 3 |
|---|---|---|---|---|
| Motor impairment | no phenotype | clasping | clasping + dragging/curling toes | paralysis |
| Tremor | none | mild | moderate | severe |
| Rigidity | none | mild | moderate | severe |

The data show that DR6$^{-/-}$ mice do not show increased immobility in comparison to their wild-type counterparts, but do demonstrate an ALS-like neurological phenotype (e.g., less rearing activity suggesting hind limb paresis) at approximately 14 weeks of age, although differences in time on the rotarod and weight may be seen as early as 9 weeks of age, each of which steadily decrease as time progresses (FIGS. 4-7). However, motor neuron loss in DR6$^{-/-}$ mice reaches a threshold for clinical symptoms at about 14 weeks of age in which motor impairment, rigidity, and tremor scores begin to reflect paralysis and/or severe disease progression, which is not dependent on the sex of the animal (FIG. 2). Symptomatic DR6$^{-/-}$ animals have decreased weight and significant motor abnormalities reflecting both upper and lower motor neuron impairment (FIG. 3), and die at about 21 weeks of age.

Example 3: Anatomic Analysis of Animals Comprising a Mutation in a DR6 Locus Eight wild-type and eight DR6 knockout mice, at about 20 weeks of age, were perfused with 50 mL of saline solution followed by 50 mL of 4% paraformaldehyde (PFA) solution in acetate buffer at pH 6.5 and 50 ml of 4% PFA solution in borate buffer at pH 9.5. After the perfusion of the animals, brains and spinal cords of the mice were collected and put in 15% followed by 30% of sucrose solution in borate buffer until they dropped. Then, the tissues were embedded in OCT and were frozen using 2-methylbutane.

The frozen tissues were cut, mounted on slides, and immunostained with Hematoxylin and eosin (H&E) and Luxol fast blue. Four H&E stained slides per spinal cord were randomly selected to count the number of motor neurons in each spinal cord.

Figure 9:
FIG. 9 shows in the top panel a representative slide of a brain isolated from a wildtype (left) or DR6$^{-/-}$ (right) animal and immunostained with hematoxylin and eosin. Also shown on the bottom panel are the number of motor neurons in the spinal cords (y-axis; mean number of motor neurons) of wild-type (left bar) or DR6$^{-/-}$ (knockout; right bar) animals.
Figure 9:
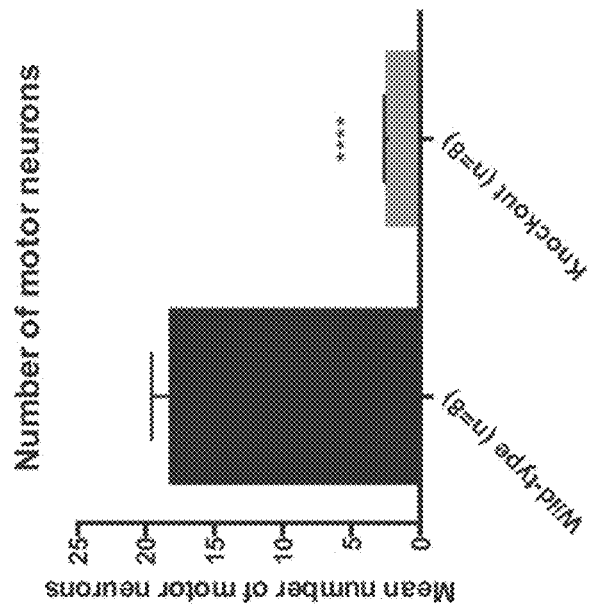

A representative slide is provided in FIG. 9. The mean of number of motor neurons per slide in spinal cords of wild-type mice is about 18, whereas for knockout mice it is about 2 with a p-value less than 0.0001 (FIG. 9). This shows that symptomatic DR6 knockout mice have a significant loss of motor neurons in their spinal cords in comparison to their wild-type counterparts. In addition, the spinal cords of knockout mice exhibit spongiform pathology, which resembles the human brain pathology of Creutzfeldt-Jakob disease patients, suggesting a possibility of prion-like motor neuron disease phenotype in these animals.

Example 4: Expression of Neuronal Proteins by Animals Comprising a Mutation in a DR6 Locus Total mRNA was collected from the brains and spinal cords of 10 wild-type and 7 DR6 knockout mice at about 20 weeks of age. RT-PCR with Taqman® was then performed on these mRNA samples. Mean mRNA levels for myelin binding protein (MBP), nerve growth factor receptor (NGFR), choline acetyltransferase (Chat), Mnx homeobox, glutamate [NMDA] receptor subunit 3B (Grin3b), and glutamate receptor 2(Gria2) genes were then normalized by the expression of beta actin in the samples.

Figure 10:
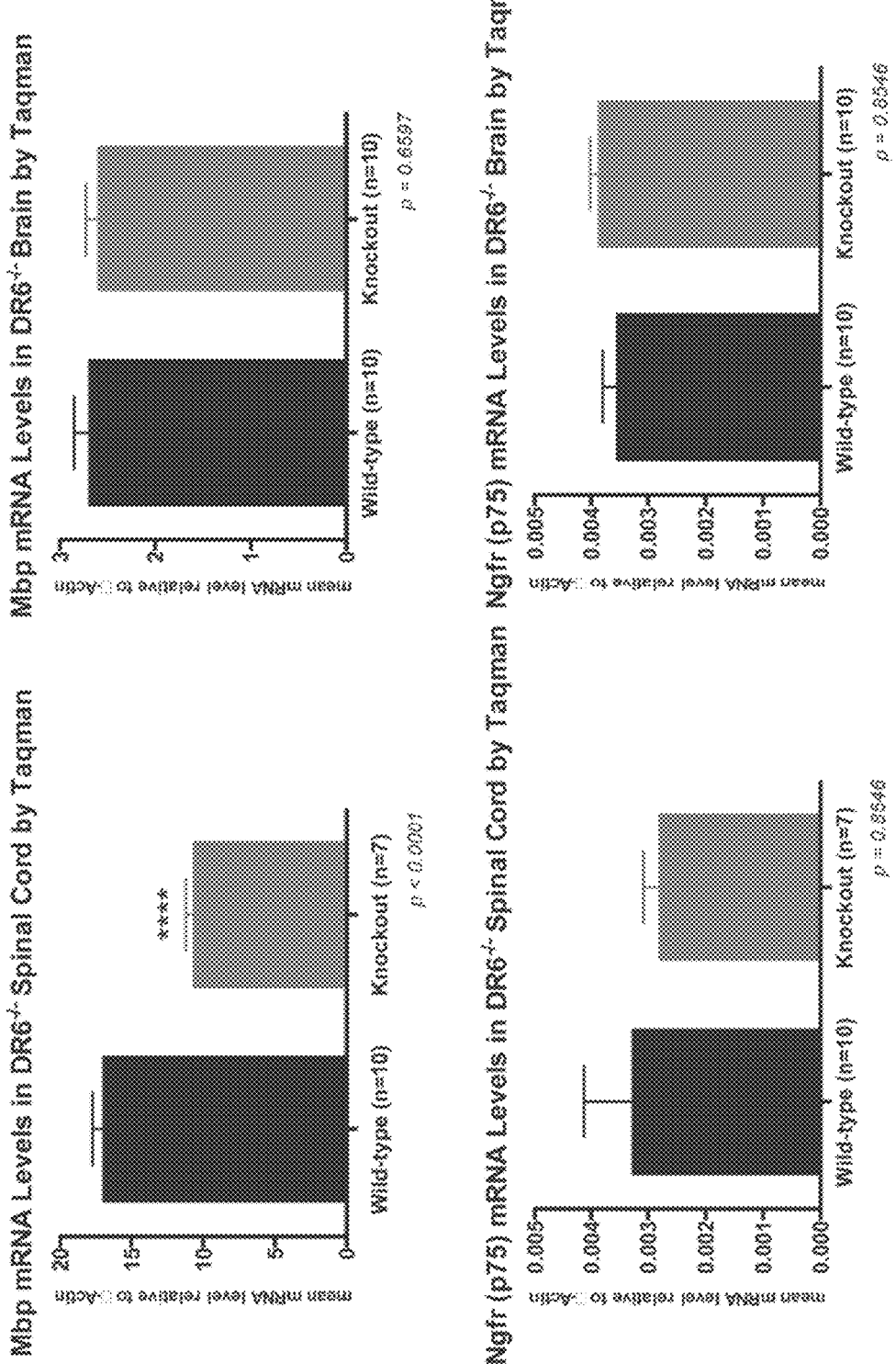
FIG. 10 shows the level of mRNA (mean mRNA level relative to β-actin; y-axes) of MBP (top panels) or NGFR (bottom panels) in the spinal cords (left panels) and brains (right panels) of wild-type (left bars) or DR6$^{-/-}$ (knockout; right bars) animals.
Figure 11:
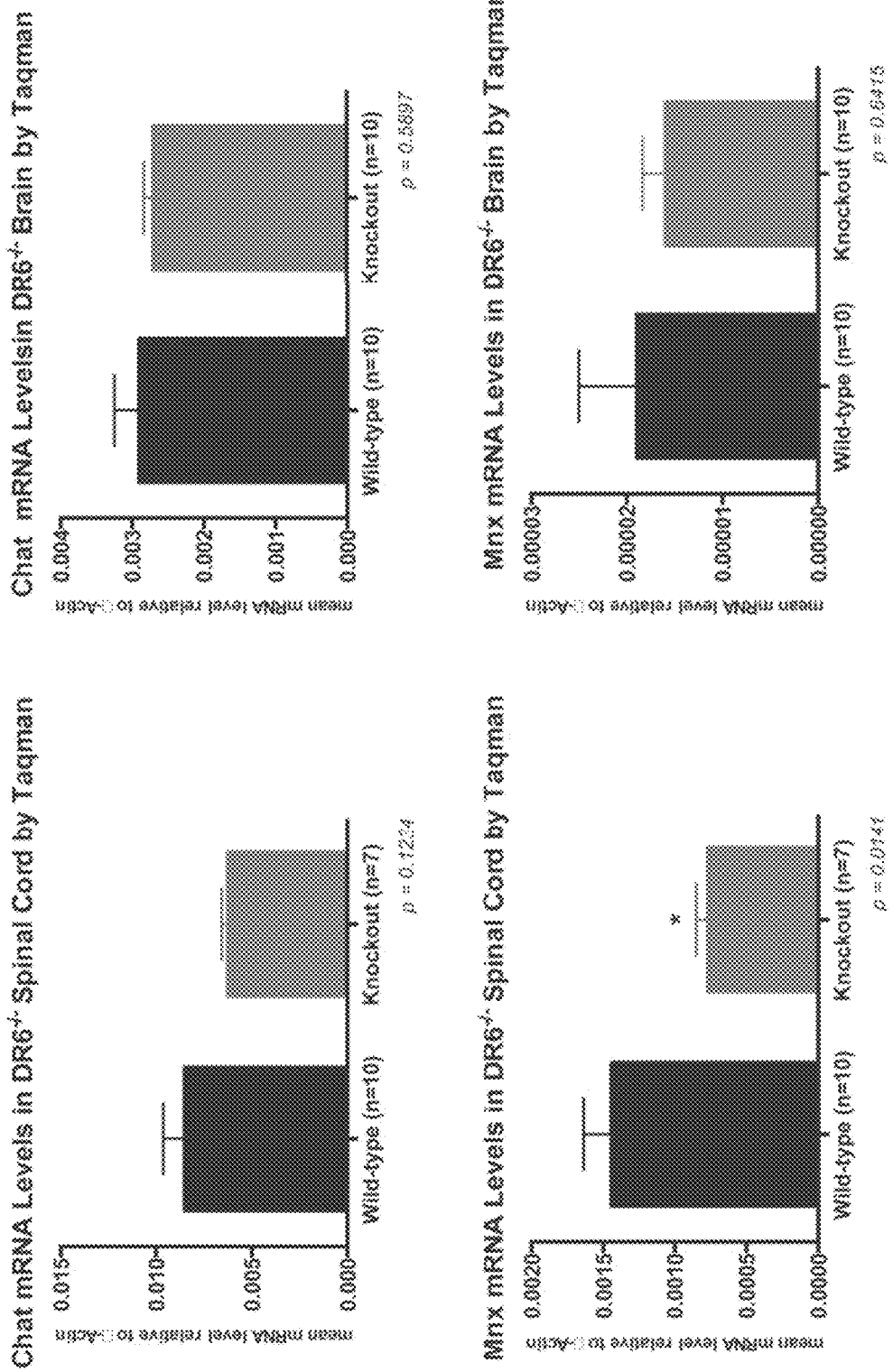
FIG. 11 shows the level of mRNA (mean mRNA level relative to β-actin; y-axes) of Chat (top panels) or Mnx (bottom panels) in the spinal cords (left panels) and brains (right panels) of wild-type (left bars) or DR6$^{-/-}$ (knockout; right bars) animals.
Figure 12:
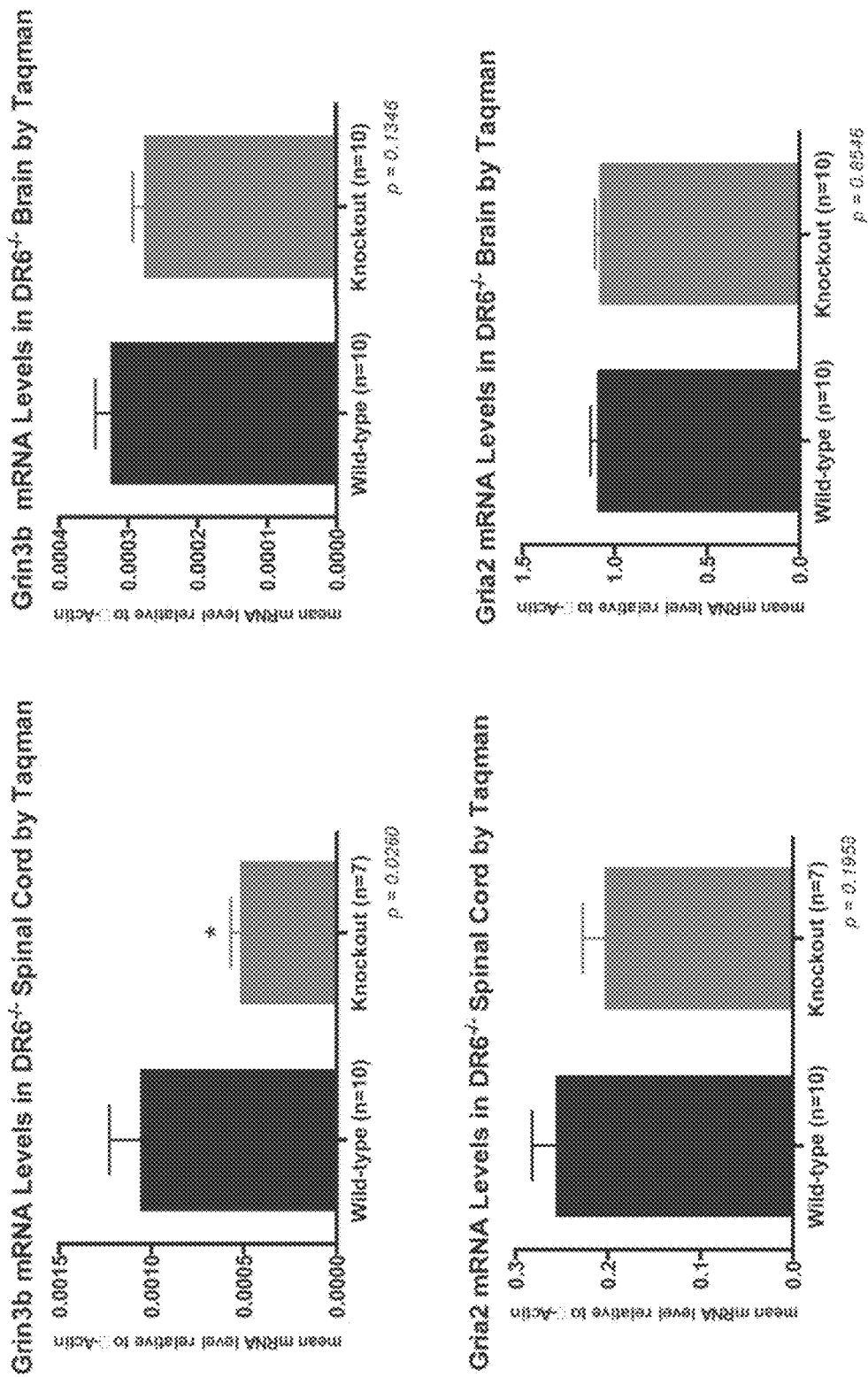
FIG. 12 shows the level of mRNA (mean mRNA level relative to β-actin; y-axes) of Grin3b (top panels) or Gria2 (bottom panels) in the spinal cords (left panels) and brains (right panels) of wild-type (left bars) or DR6$^{-/-}$ (knockout; right bars) animals.

FIGS. 10-12 show the expressions of MBP, Mnx, and Grin3b are reduced in the spinal cords but not in the brains of DR6 knockout mice, strengthening the evidence for the loss of motor neurons in the spinal cords of symptomatic DR6 knockout mice. The expressions of Ngfr, Chat and Gri2a are not affected.

Example 5: Gene Expression Patterns in Animals Comprising a Mutation in the Endogenous DR6 Locus Gene profiling was performed with RNA extracted from brain and spinal cord tissues of 10 week-old wild-type mice (n=5 males), pre-symptomatic 10-week old DR6$^{-/-}$ mice (n=5 males), 20 week old wild-type mice (n=6 male and 3 female), and symptomatic 20 week old DR6$^{-/-}$ mice (n=6 male and 3 female).

Brains and spinal cords from 10 and 20 weeks old DR6$^{-/-}$ mice have significant overlap of gene expression and share similar gene expression signatures (data not shown). Seventy-three genes significant in both brain and spinal cords of 10 week old DR6$^{-/-}$ mice were identified as potentially involved in disease mechanism and progression. Gene signatures from spinal cords of 10 weeks old DR6$^{-/-}$ mice also highly correlated with human ALS and murine SOD1 biosets (data not shown), further confirming DR6$^{-/-}$ mice as an ALS mouse model. Brain and spinal cords of 10 week old DR6$^{-/-}$ mice showed an immune response-linked gene expression signature that suggested the disease process involved an inflammatory pathway.

Example 6: DR6$^{-/-}$ Animals Show Peripheral Immune Cell Homeostasis

Blood, bone marrow, thymus and splenic tissues were isolated from 10 and 20 week old wild-type and DR$^{-/-}$ mice for phenotyping by flow cytometric analysis using antibodies to CD3, B220, CD21 and CD2 (all obtained from BD Biosciences San Jose, Calif. or eBioscience San Diego, Calif.). Additionally, cytokine and chemokine concentrations in sera isolated from 20 week old wild-type and DR6$^{-/-}$ mice were evaluated using Luminex Mouse Cytokine Magnetic 20-Plex Panel for simultaneous quantitative determination of FGF basis, GM-CSF, IFN-γ, IL-1α, IL-1β, IL-2, IL-4, IL-5, IL-6, IL-10, IL-13, IL-12 (p40/p70), IL-17, IP-10, KC, MCP-1, MIG, MIP-1α, TNF-α, and VEGF.

Figure 13:
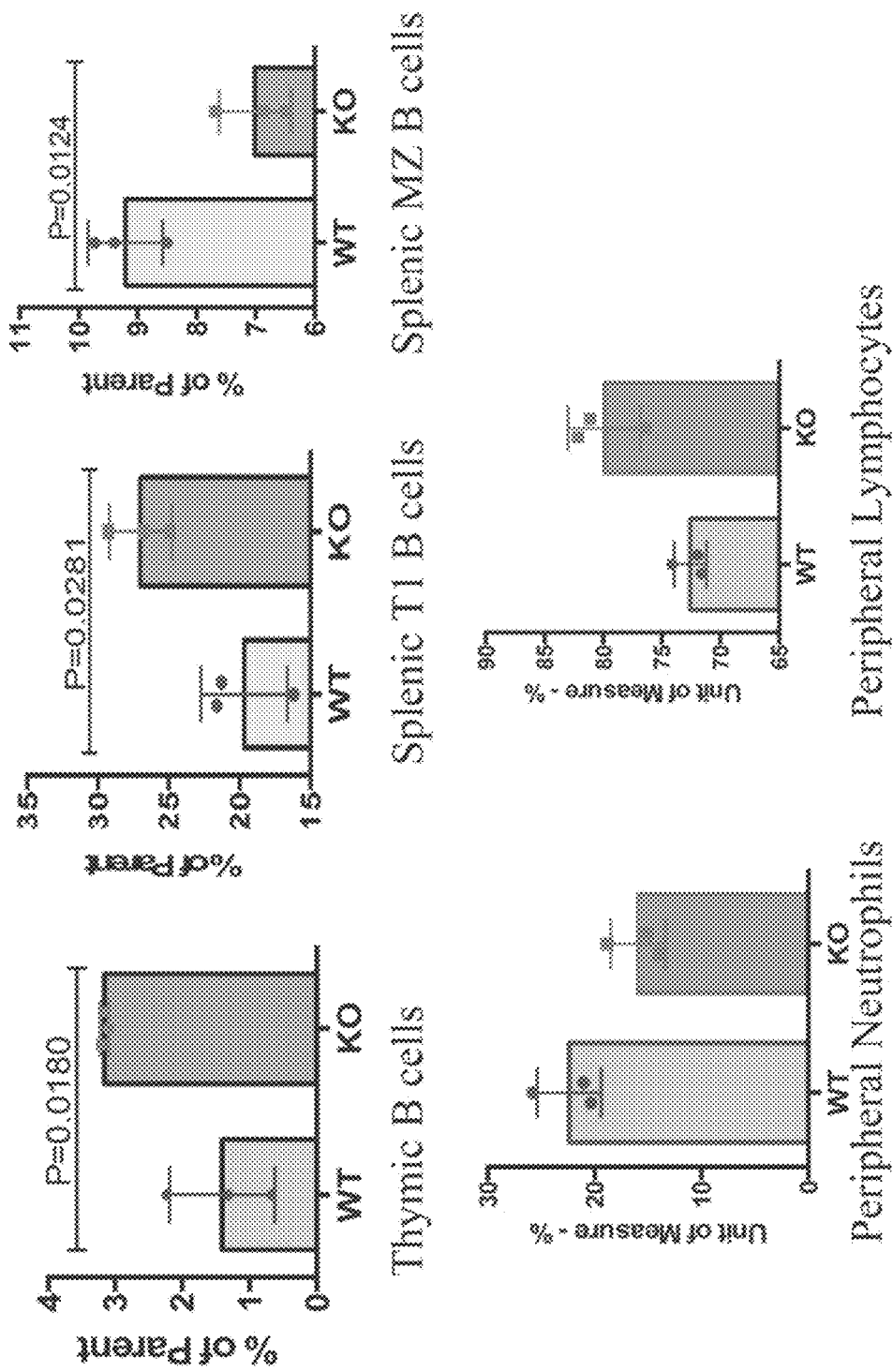
FIG. 13 shows the number of different cells as a percent of parent cells (% of parent; y-axis) obtained from the thymus, spleen or periphery of wildtype (WT; x-axis) or DR6$^{-/-}$ (KO; x-axis) mice.
Figure 14:
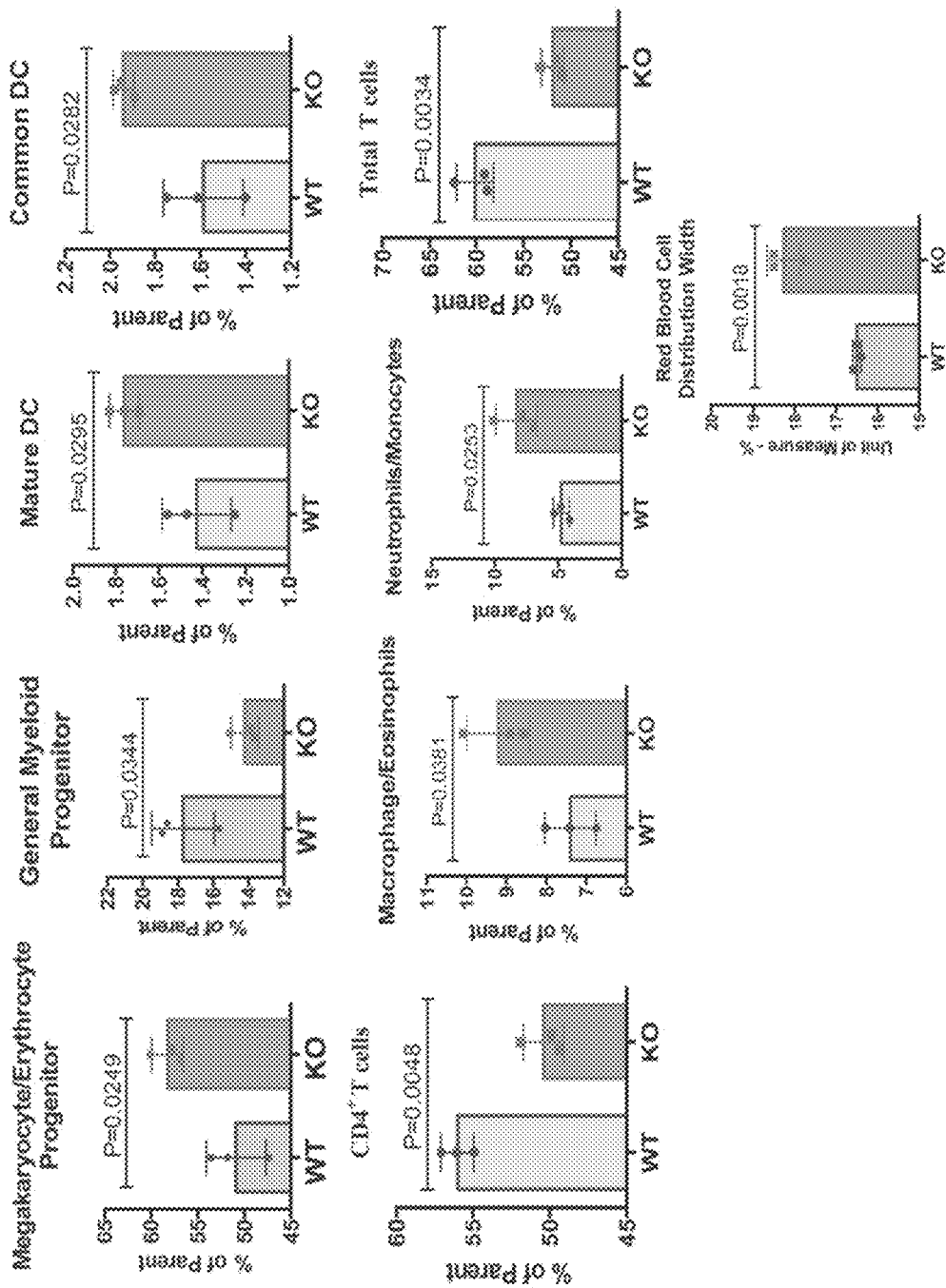
FIG. 14 shows the number of different cells as a percent of parent cells (% of parent; y-axis) obtained from the thymus, spleen or periphery of wild-type (WT; x-axis) or DR6$^{-/-}$ (KO; axis) mice.
Figure 15:
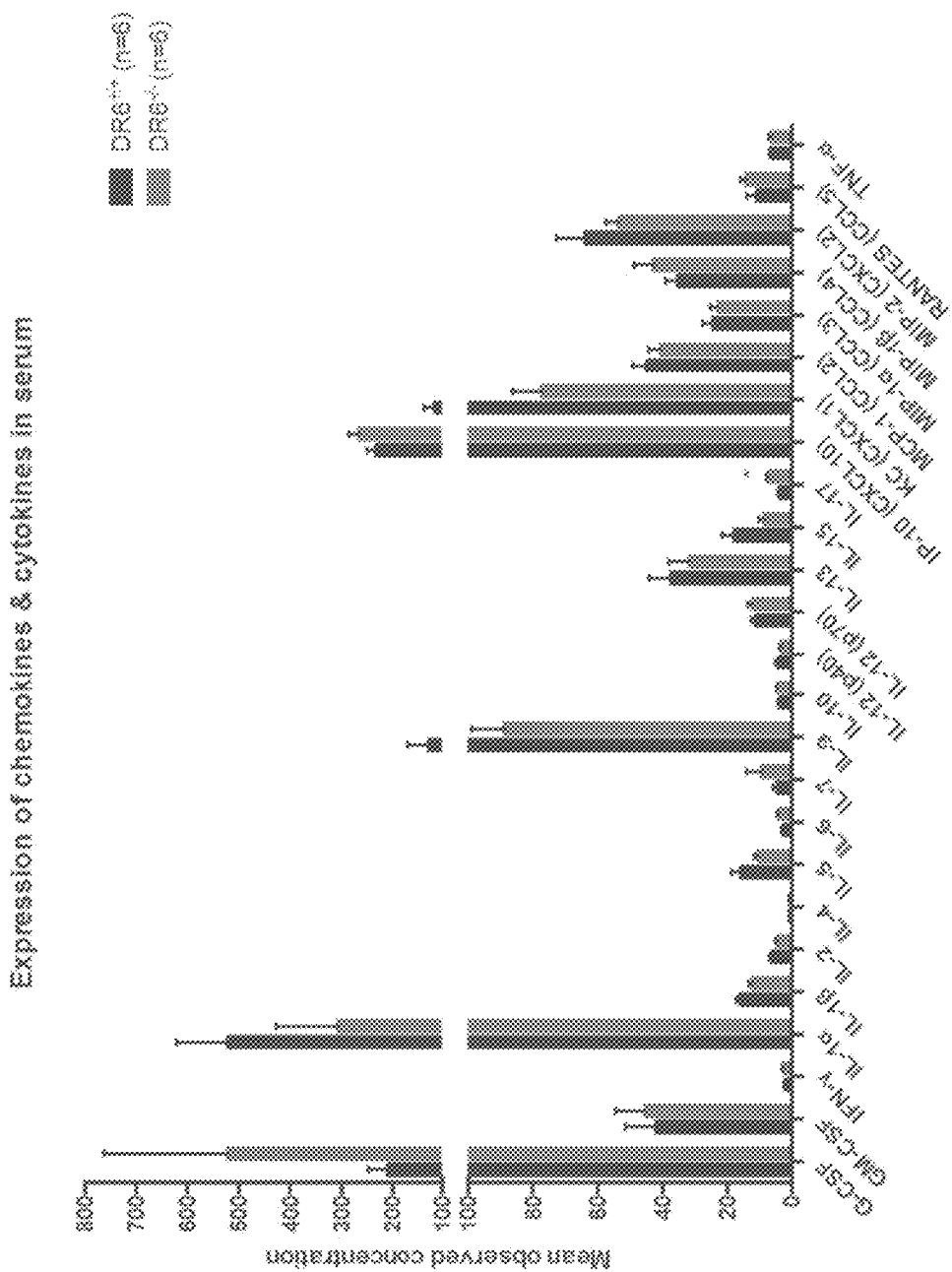
FIG. 15 shows the concentration (mean observed concentration; y-axis) of different cytokines or chemokines (x-axis) in the serum of wild-type (n=6; black bars) or DR6$^{-/-}$ (n=6; grey bars) animals.

Neither 10 nor 20 week old DR6 mice demonstrated a robust effect in peripheral immune cell homeostasis (FIGS. 13-14). DR6$^{-/-}$ mice showed normal B cell development and early cell progenitor homeostasis in the bone marrow, a 2 fold increase in B cells in the thymus, an increase in splenic transitional 1B cells and decrease in splenic marginal zone B cells, a decrease in peripheral neutrophils and an increase in peripheral lymphocytes (FIG. 13). In the bone marrow, DR6$^{-/-}$ mice showed a 14% increase in megakaryocyte/erythrocyte progenitors, a 20% decrease in myeloid progenitors, but no significant changes in total cell number (FIG. 14). While DR6$^{-/-}$ animals showed normal T cell development and differentiation in the thymus, there was a 20% increase in splenic common/mature dendritic cells, a 25% increase in macrophages and eosinophils, a 75% increase in splenic neutrophils and monocytes, and a 19% decrease in CD4$^+$ T cells. However, there was no significant change in total cell number in the spleen (data not shown). Moreover, cytokine and chemokine levels in the sera of 20 week old DR6$^{-/-}$ mice is not changed compared to wild-type animals (FIG. 15). These data indicates that DR6$^{-/-}$ mice do not go through an overall inflammation response during disease progression, and suggests the inflammation response seen with the genetic profiling may be localized neuroinflammation.

Example 7: Embryonic Stem-Cell Derived Motor Neurons from DR6+/− Mice Demonstrate Increased Oxidative Stress Inner mass embryonic stem cells were isolated from wild-type (DR6$^{+/+}$) or heterozygous DR6$^{+/-}$ animals were cultured in embryonic stem cell medium (ESM; DMEM+

15% Fetal bovine serum+Penicillin/Streptomyocin+Glutamine+Non-essential amino acids+nucleosides+β-mercaptoethanol+Sodium pyruvate+LIF) for 2 days to allow the formation of embryoid bodies (EBs). EBs were cultured for two days in differentiation medium (DM: Advanced DMEM/F12+Neurobasal medium+10% Knockout serum+Penicillin/Streptomyocin+Glutamine+β-mercaptoethanol), and for an additional 5 days in DM and retinoic acid and smoothened agonist to obtain motor neuros. Dissociated motor neurons were plated and matured in embryonic stem cell-derived motor neuron medium (ESMN; Neurobasal medium+2% Horse serum+B27+Glutamine+Penicillin/Streptomyocin+β-mercaptoethanol+10 ng/ml GDNF, BDNF, CNTF) to establish stable motor neuron lines. Motor neuron counts were determined at day 7, and oxidative stress measured 1 and 7 days after the establishment of stable motor neuron lines.

Figure 16A:
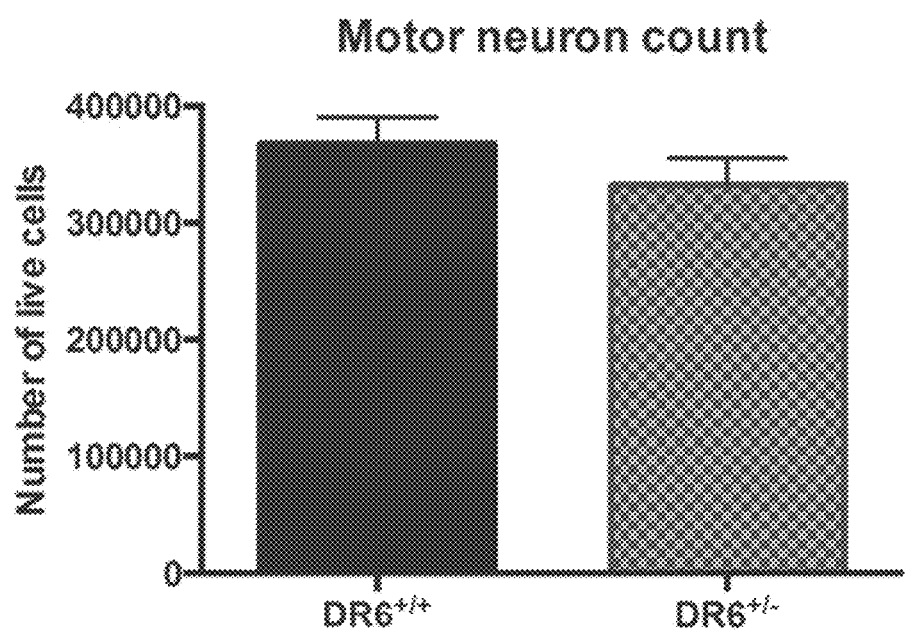
FIG. 16A shows the number of live cells (y-axis) obtained after culture of embryonic stem cell-derived motor neurons obtained from wild-type animals (DR6$^{+/+}$; black bar; axis) and DR6$^{+/-}$ animals (DR6$^{+/-}$; checkered bar; x-axis).
Figure 16B:
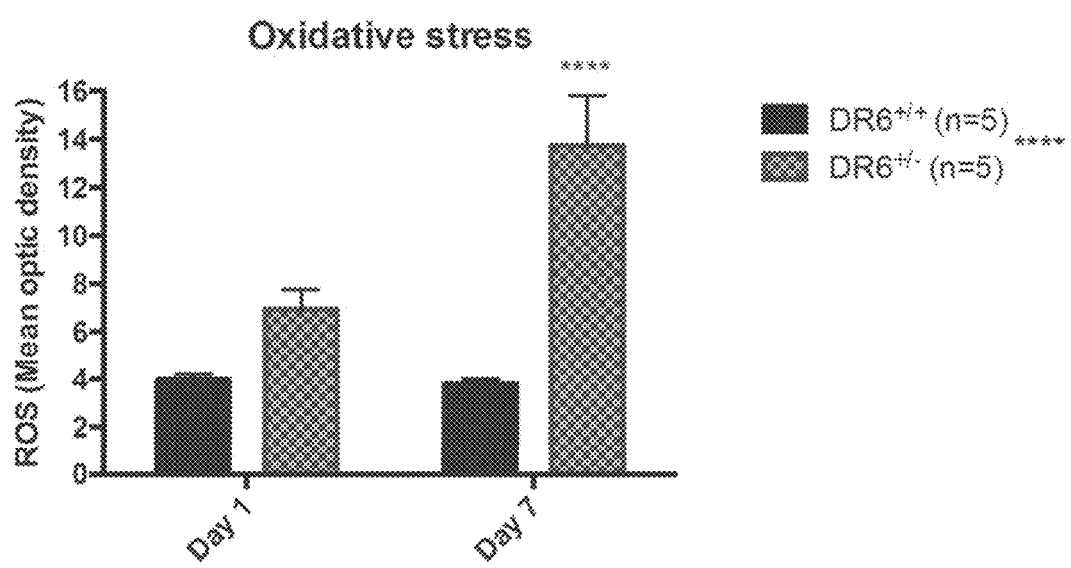
FIG. 16B shows the oxidative stress (mean optic density; y-axis) of embryonic stem cell-derived motor neurons obtained from wild-type (DR6$^{+/+}$; black bars) and heterozygous animals (DR6$^{+/-}$; checkered bars) animals at day 1 or day 7 (x-axis) in embryonic stem cell-derived motor neuron (ESMN) medium. **** for P≤0.0001.

The data shows that $DR6^{+/-}$ animals generate the same number of motor neurons as wild-type animals, but have increased oxidative stress compared to wild-type animals (FIG. 16).

Example 8: Phenotypic Comparison of $DR6^{+/-}$ and $DR6^{+/+}$ Animals

Figure 17A:
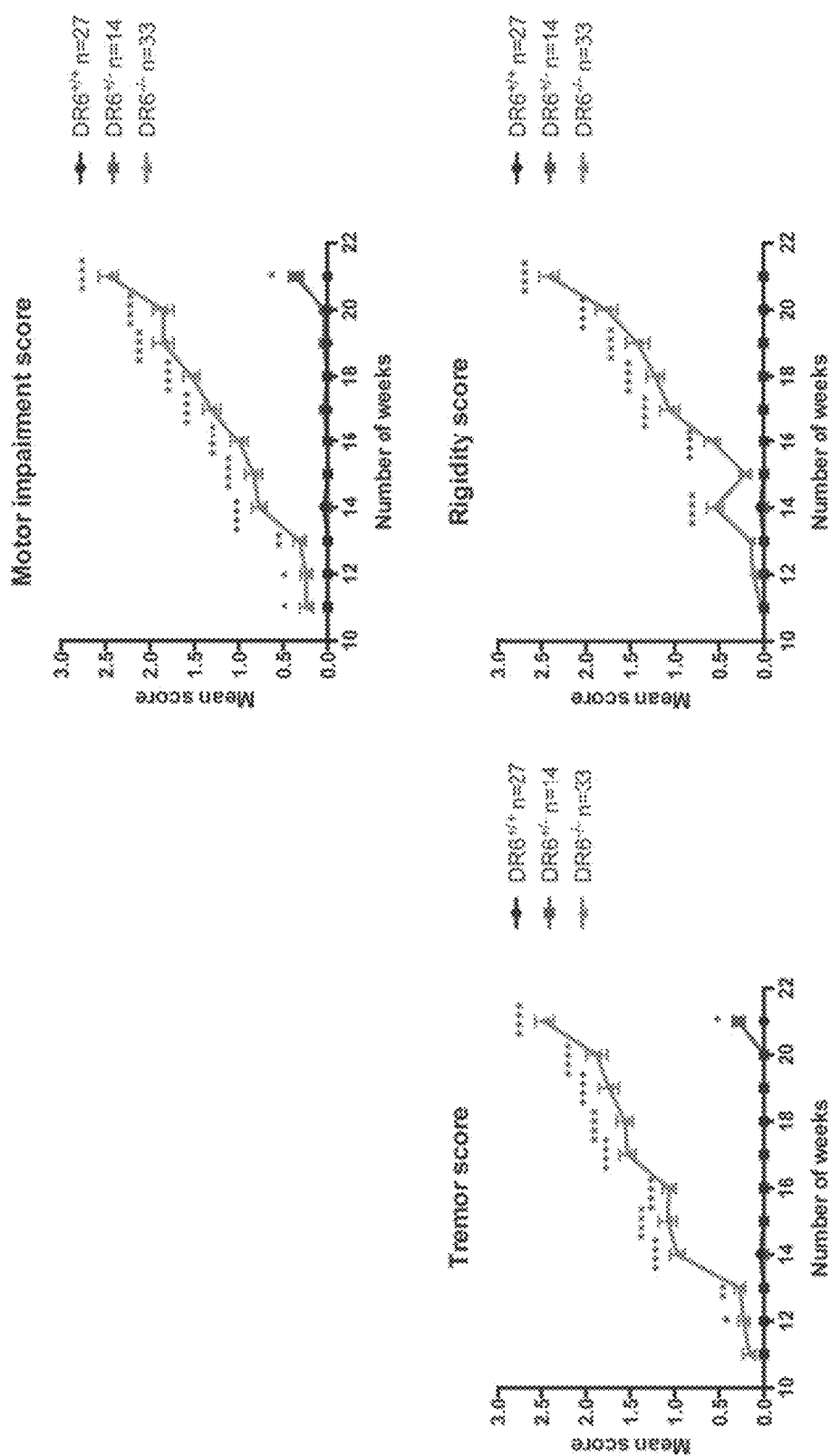
FIG. 17A shows the neurological scoring, e.g., motor impairment score, tremor score, and rigidity score, of wild-type (-●-); n=27), heterozygous DR6$^{+/-}$ (-■-; n=14), and homozygous DR6$^{-/-}$ (-▲-; n=33) animals between 10-21 weeks of age.
Figure 17B:
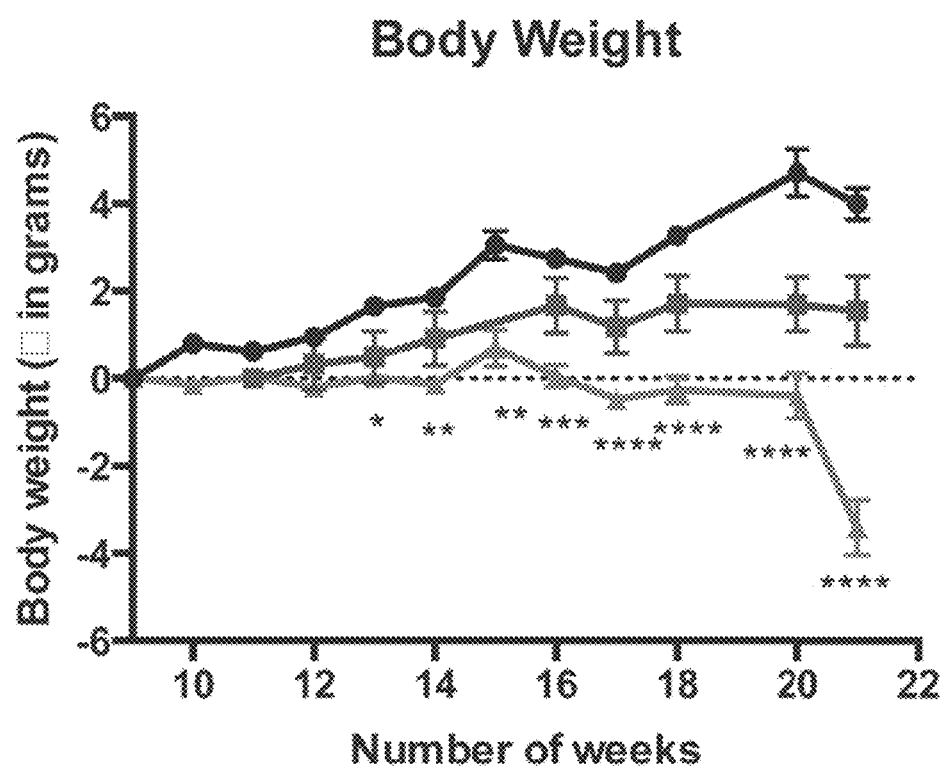
FIG. 17B shows the mean body weight (y-axis; weight in grams) of wild-type (-●-); n=27), heterozygous DR6$^{+/-}$ (-■-; n=14), and homozygous DR6$^{-/-}$ (-▲-; n=33) animals between 10-21 weeks of age. The top panel of FIG. 17C shows the median latency of wild-type (-●-); n=13), heterozygous DR6$^{+/-}$ (-■-; n=14), and homozygous DR6$^{-/-}$ (-▲-; n=15) animals to fall off a rotarod (y-axis; seconds); the bottom panel shows maximum time of wild-type (-●-); n=13), heterozygous DR6$^{+/-}$ (-■-; n=14), and homozygous DR6$^{-/-}$ (-▲-; n=15) animals to fall off a rotarod (y-axis; second) at 12 to 21 weeks of age. The maximum time spent on the rotarod was 180 seconds.
Figure 17C:
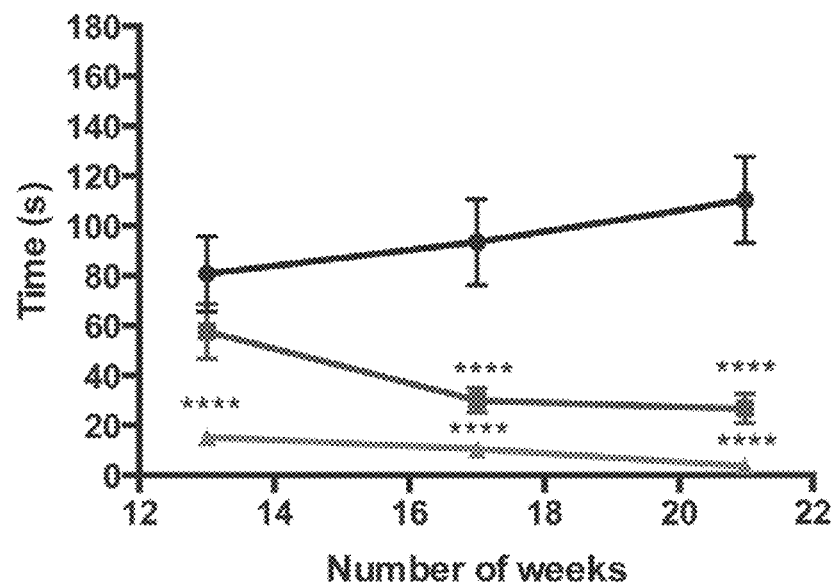
FIGS. 17D-17K show the open field locomotor behavior of wild-type, heterozygous DR6$^{+/-}$ and homozygous DR$^{-/-}$ mice, e.g., rearing (FIG. 17D), total rearing time (FIG. 17E), basic movements (FIG. 17F), immobility (FIG. 17G), fine movements (FIG. 17H), X+Y ambulation (FIG. 17I), the total distance (FIG. 17J), and total rest (FIG. 17K) over an hour for wild-type (-●-); n=27), heterozygous DR6$^{+/-}$ (-■-; n=14), and homozygous DR6$^{-/-}$ (-▲-; n=33) animals between 10-21 weeks of age.
FIGS. 17L-17Z shows the catwalk behavior, e.g., stride length (FIGS. 17L and 17M), swing speed (FIGS. 17N and 17O), interlimb coordination (FIG. 17P), swing phase (FIGS. 17Q and 17R), duty cycle (FIGS. 17S and 17T), paw print area (FIGS. 17U and 17V), stance phase (FIGS. 17W and 17X), and paw pressure (FIGS. 17Y and 17Z) of wild-type (-●-); n=27), heterozygous DR6$^{+/-}$ (-■-; n=14), and homozygous DR6$^{-/-}$ (-▲-; n=33) animals between 10-21 weeks of age. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.
Figure 17C:
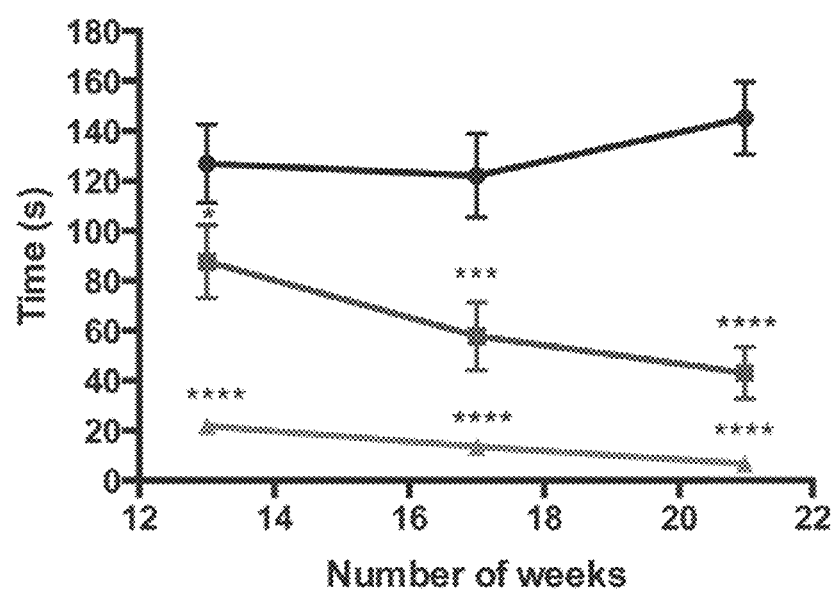
Figure 17D:
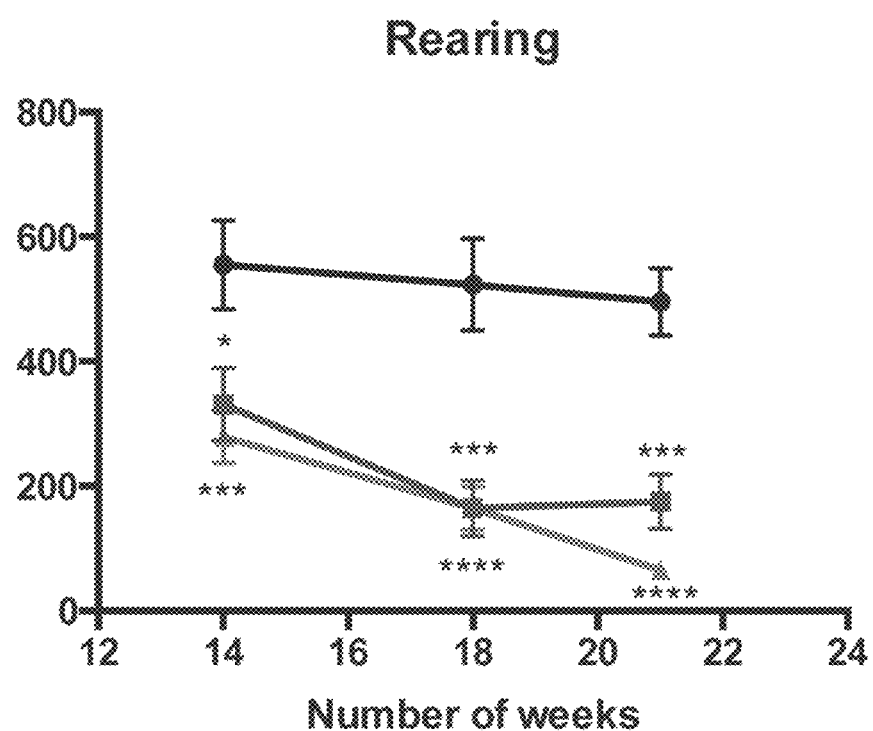
Figure 17E:
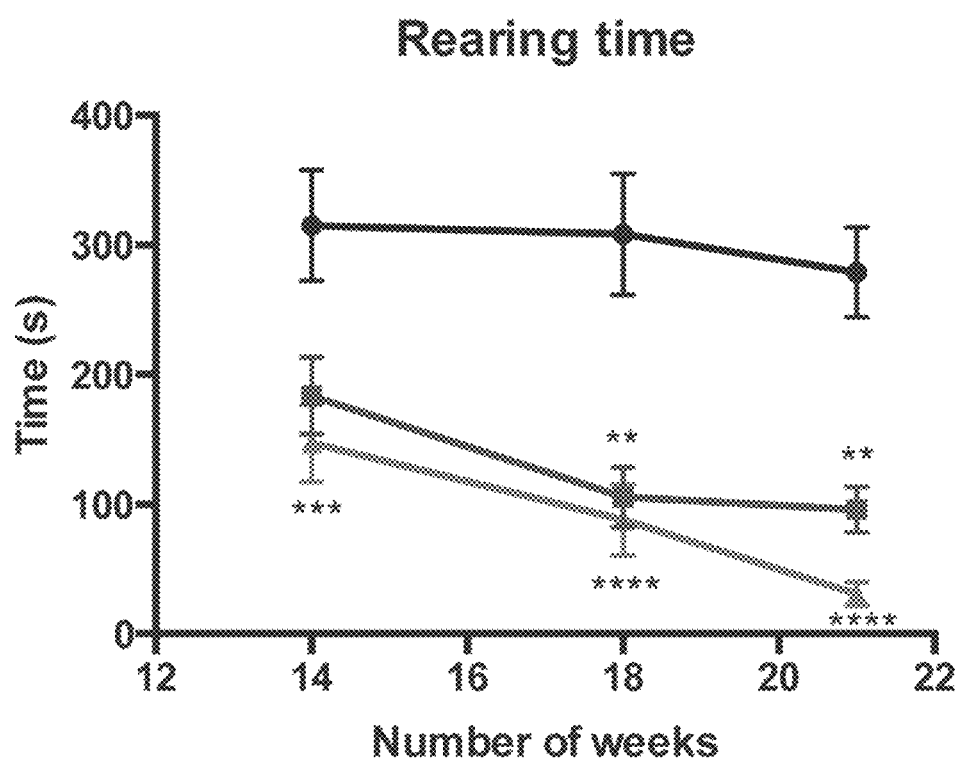
Figure 17F:
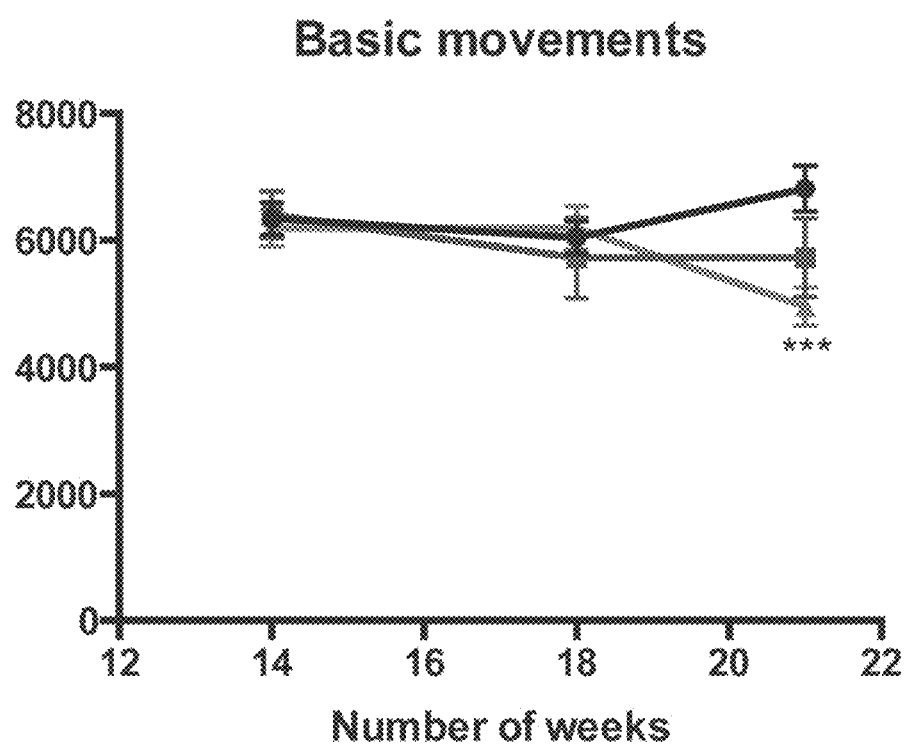
Figure 17G:
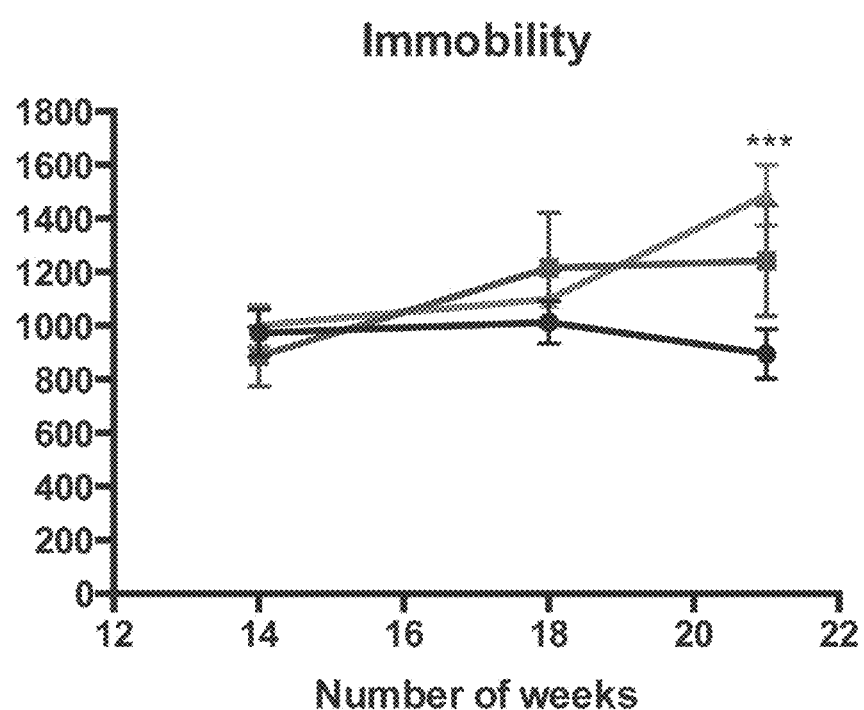
Figure 17H:
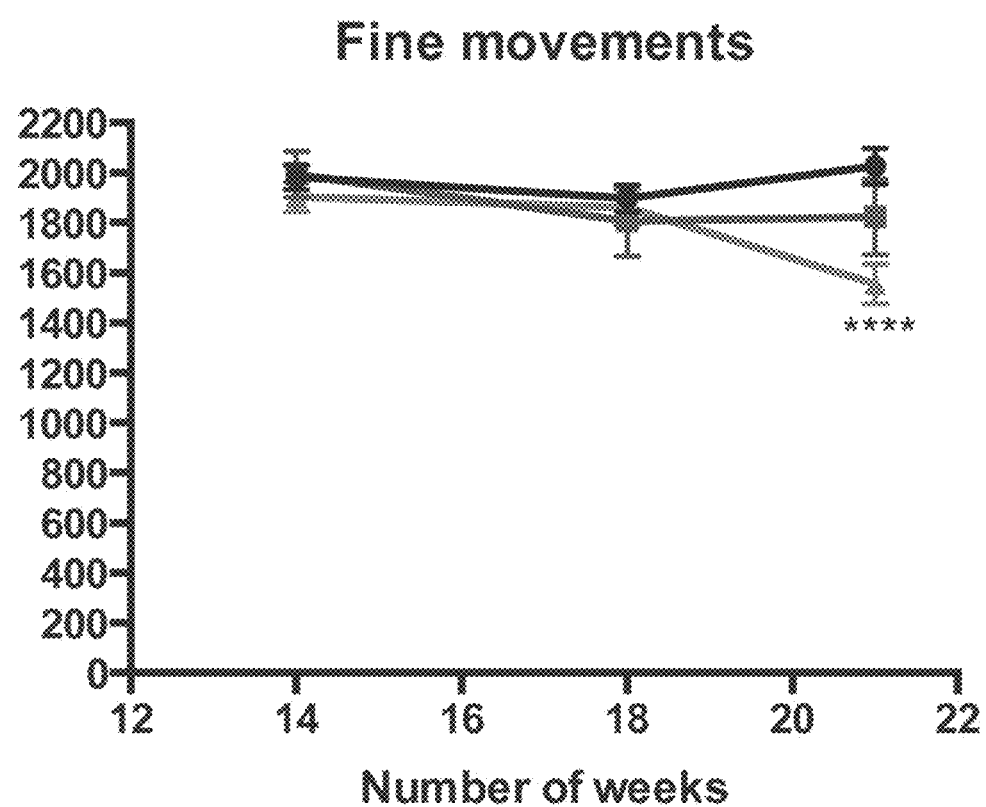
Figure 17I:
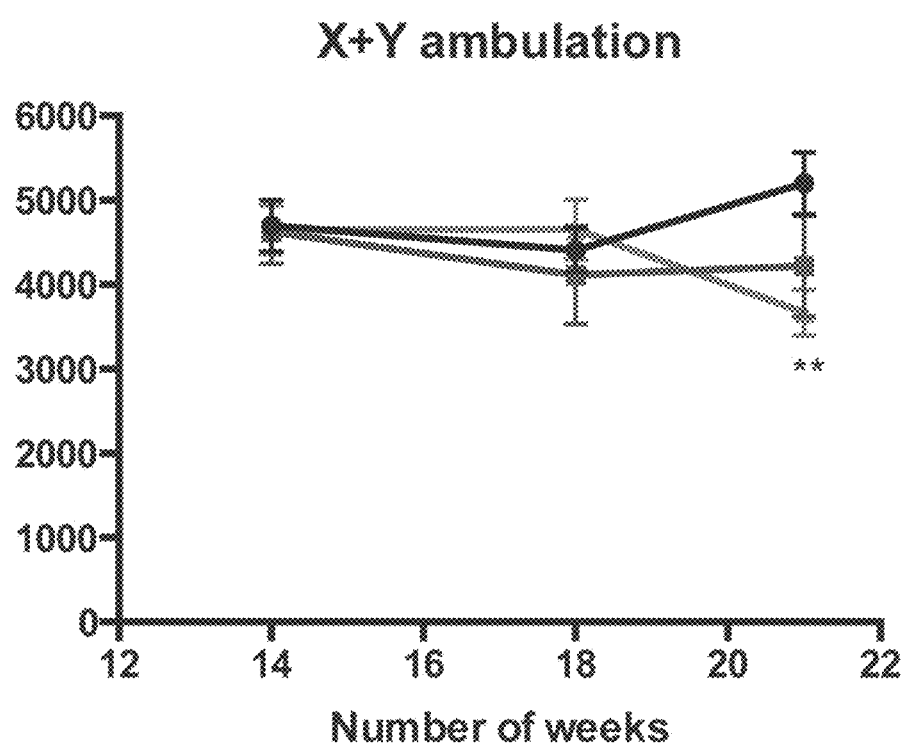
Figure 17J:
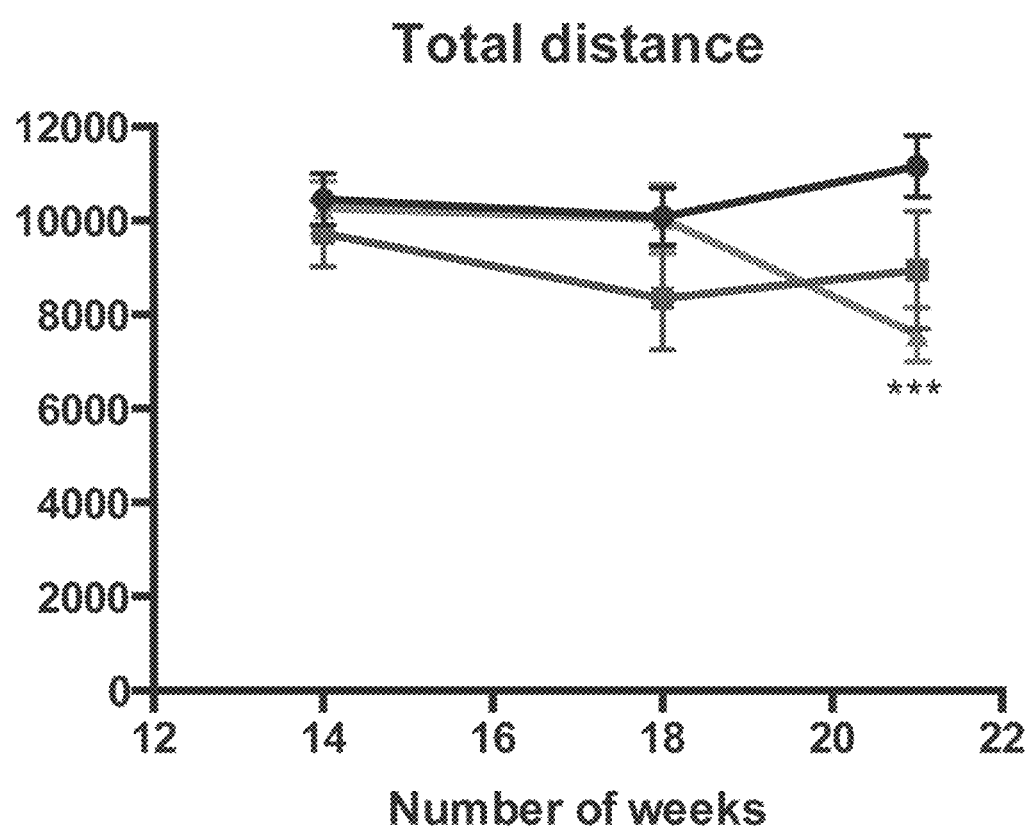
Figure 17K:
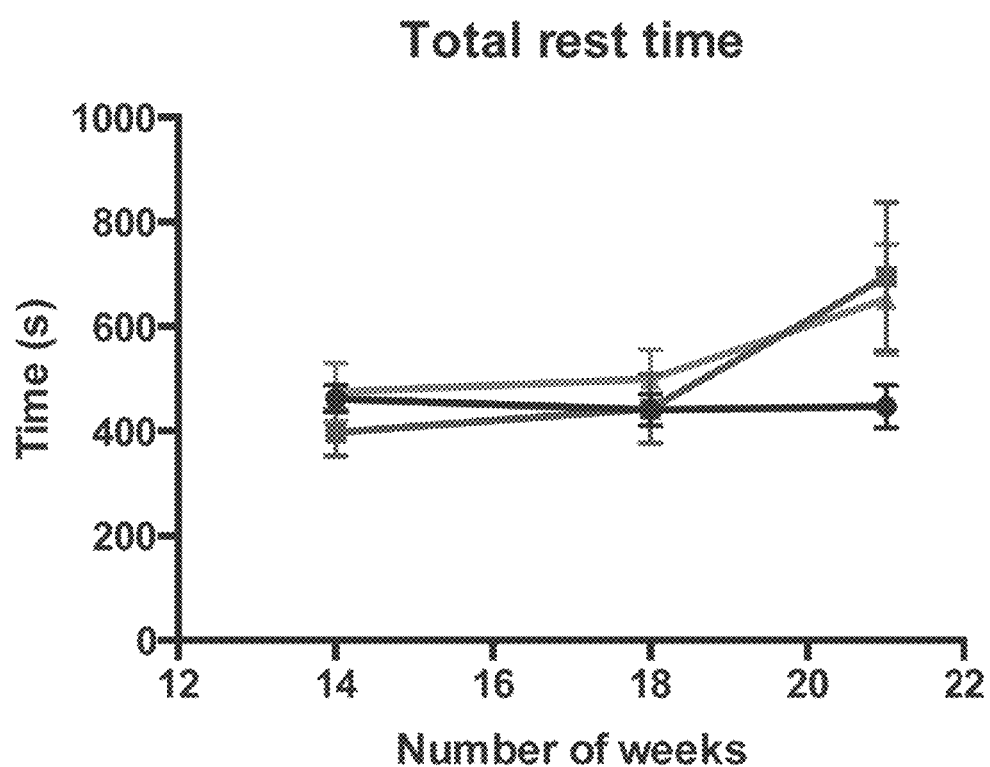

The motor function of control animals, and mice heterozygous or homozygous for the DR6 genetic modification as described in Example 1 was compared using the testing as described in Example 2. Neurological scores are compared in FIG. 17A, weight gain comparisons are shown in FIG. 17B, rotarod testing comparisons are shown in FIG. 17C, open field measurements are provided in FIGS. 17D-17K, and catwalk measurements are shown in FIGS. 17L-17Z.

Figure 17L:
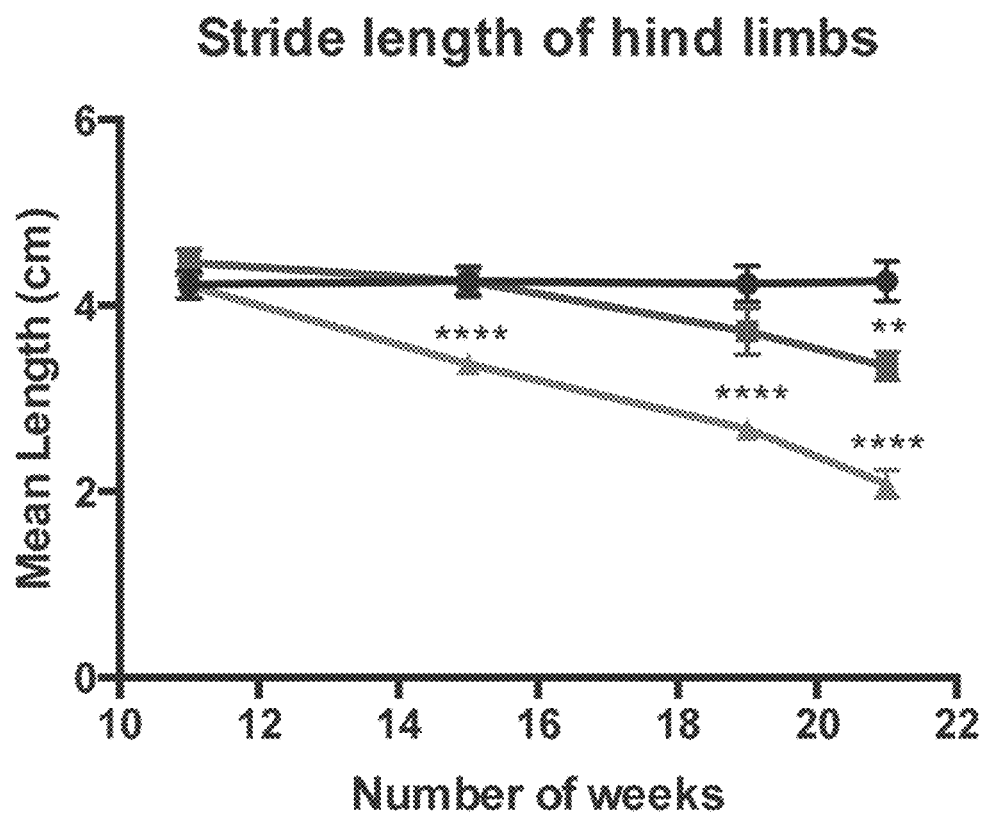
Figure 17M:
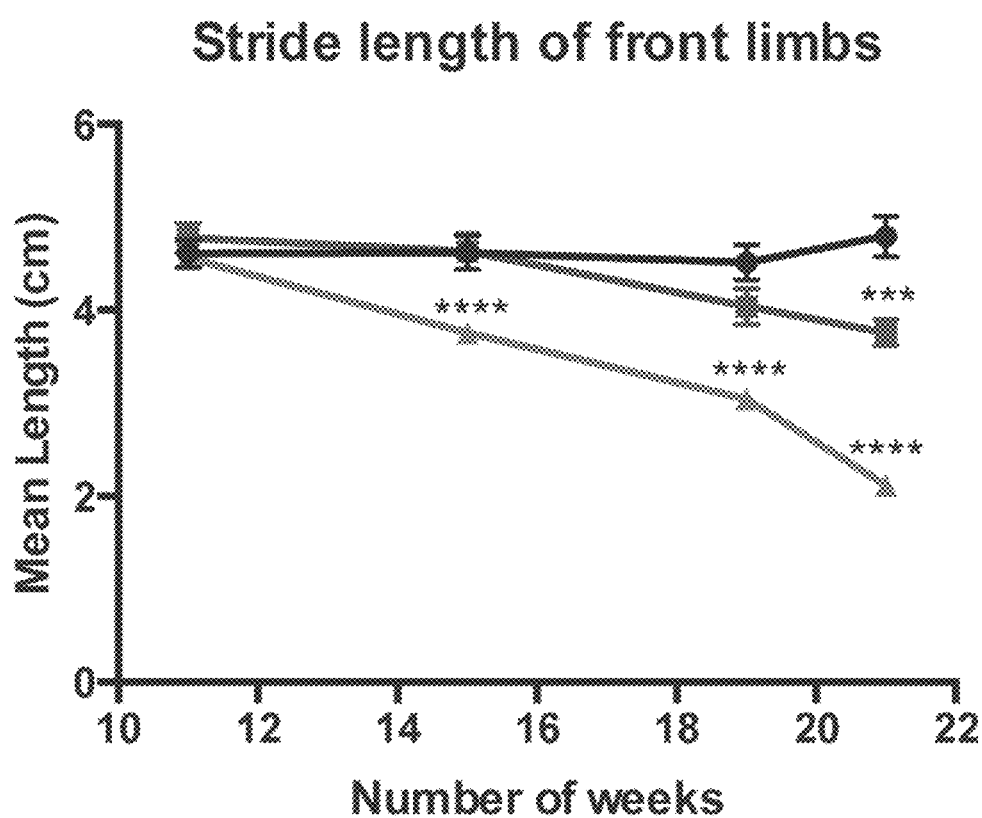
Figure 17N:
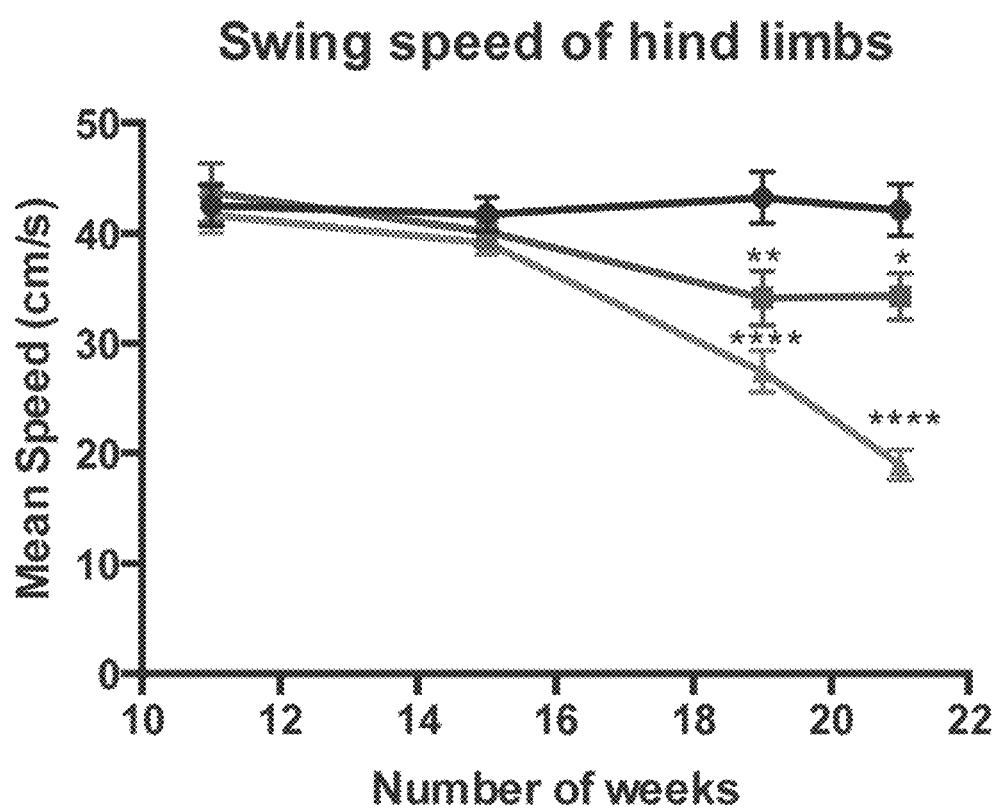
Figure 17O:
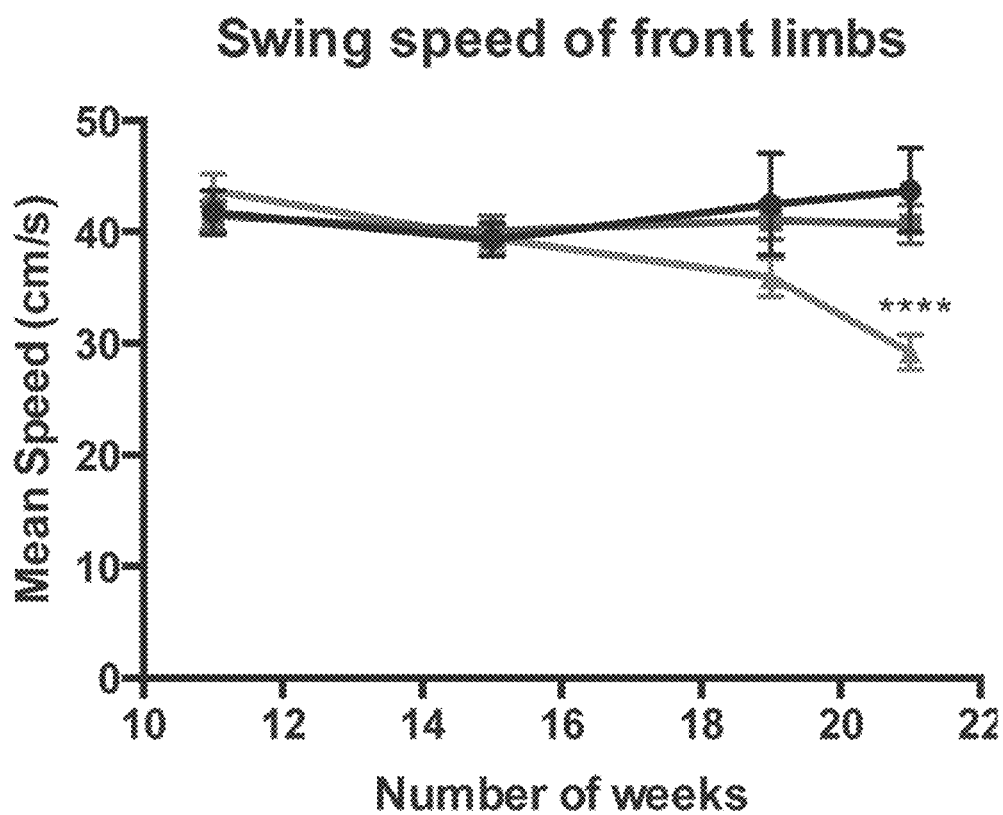

Significant "dose-dependent" type effects of the DR6 mutation were seen in the weight gain of animals (FIG. 17B), during rotarod testing (FIG. 17C), in rearing and rearing times measured in the open field tests (FIGS. 17D-17E), and in the stride length and swing speed of the hind limbs during catwalk testing (FIGS. 17L-17N).

Although heterozygous mice appeared neurologically similar to wildtype animals when overall motor function was assessed in the blinded subjective scoring assay (FIG. 17A), at 21 weeks of age, the neurological scores of heterozygous mice started trending toward the neurological scores of homozygous mice (FIG. 17A). Several other measurements followed the same pattern, whereby the phenotype of heterozygous mice trended toward that of homozygous mice after about 20 weeks of age (see, e.g., FIGS. 17F-17K, 17O).

Figure 17P:
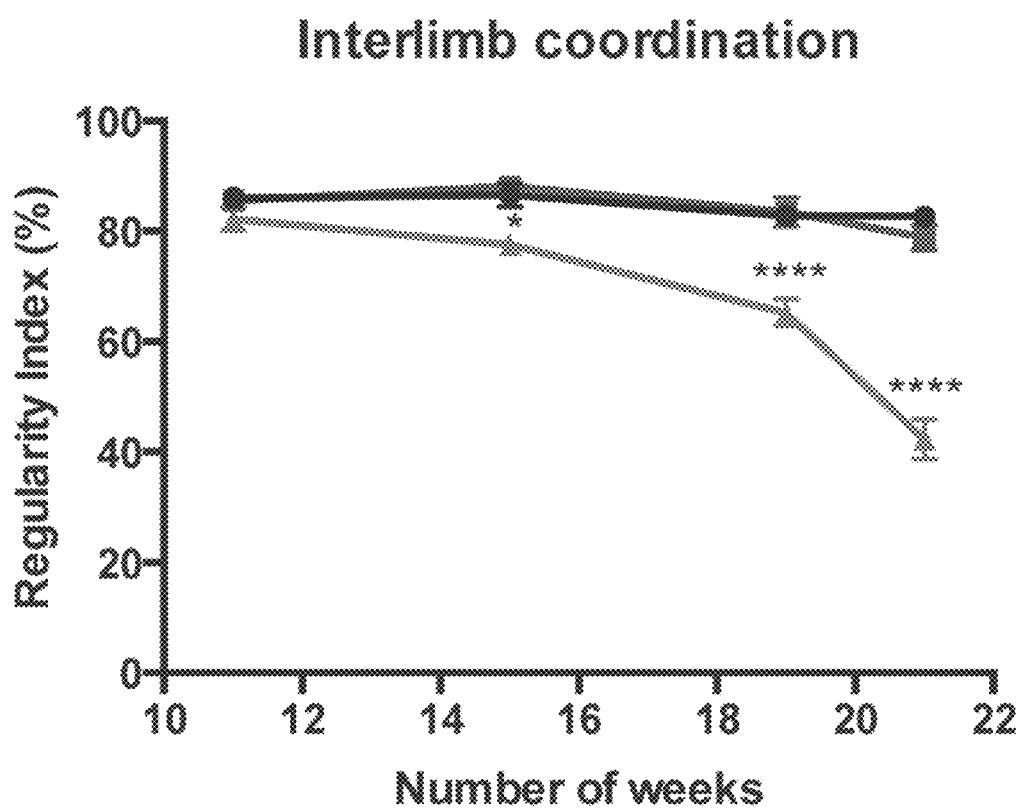
Figure 17Q:
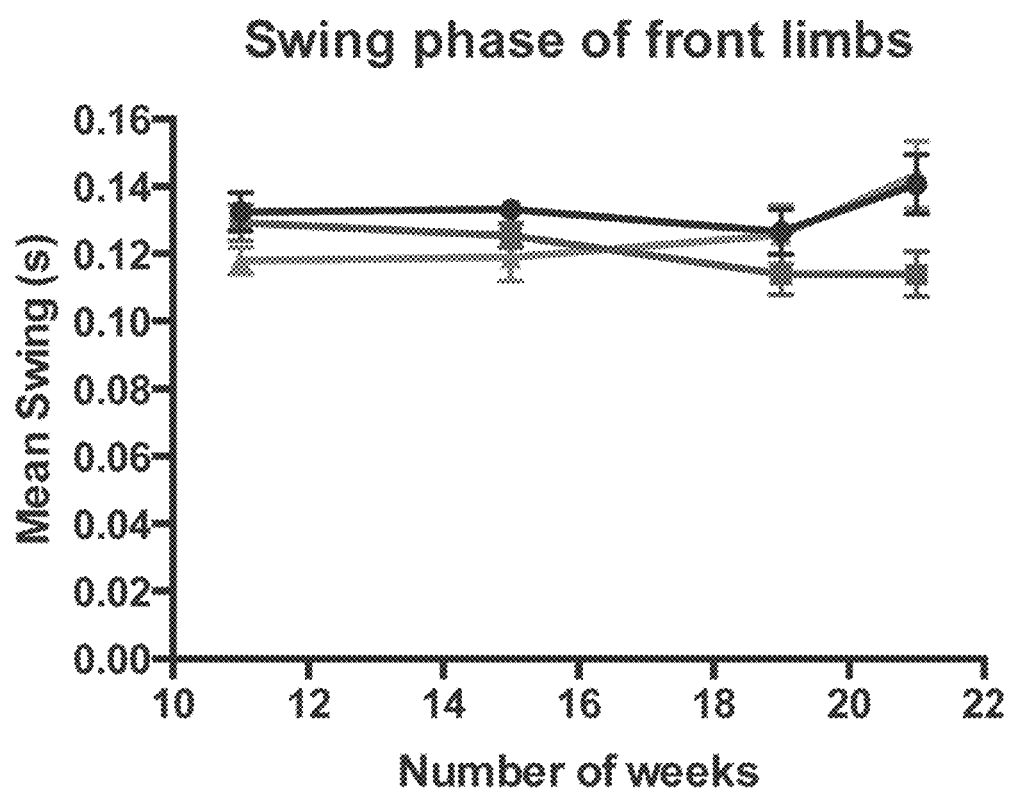
Figure 17R:
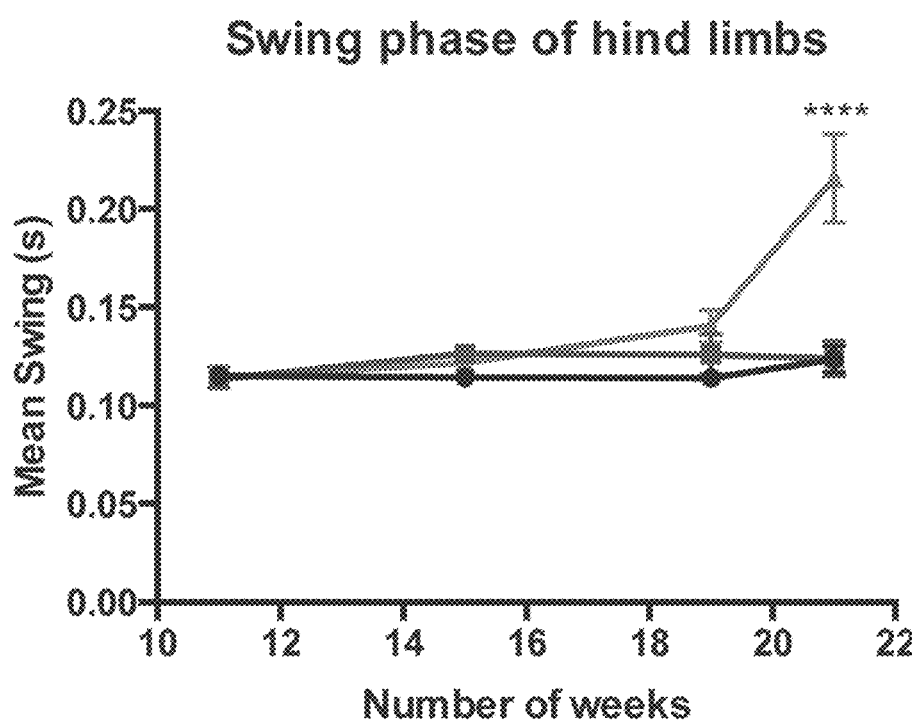
Figure 17S:
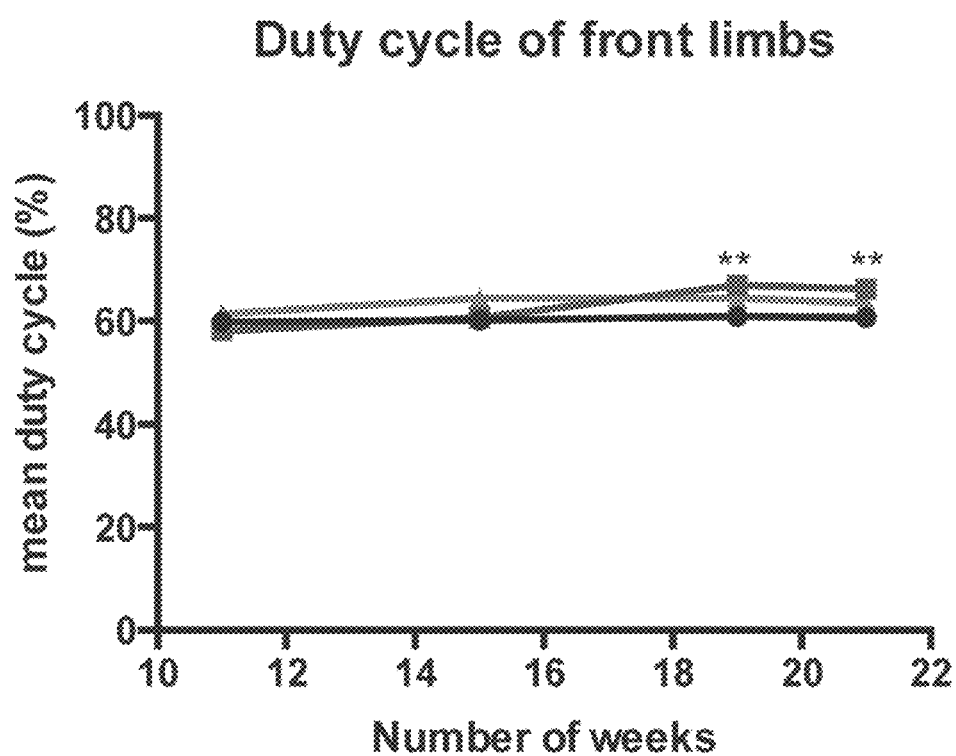
Figure 17T:
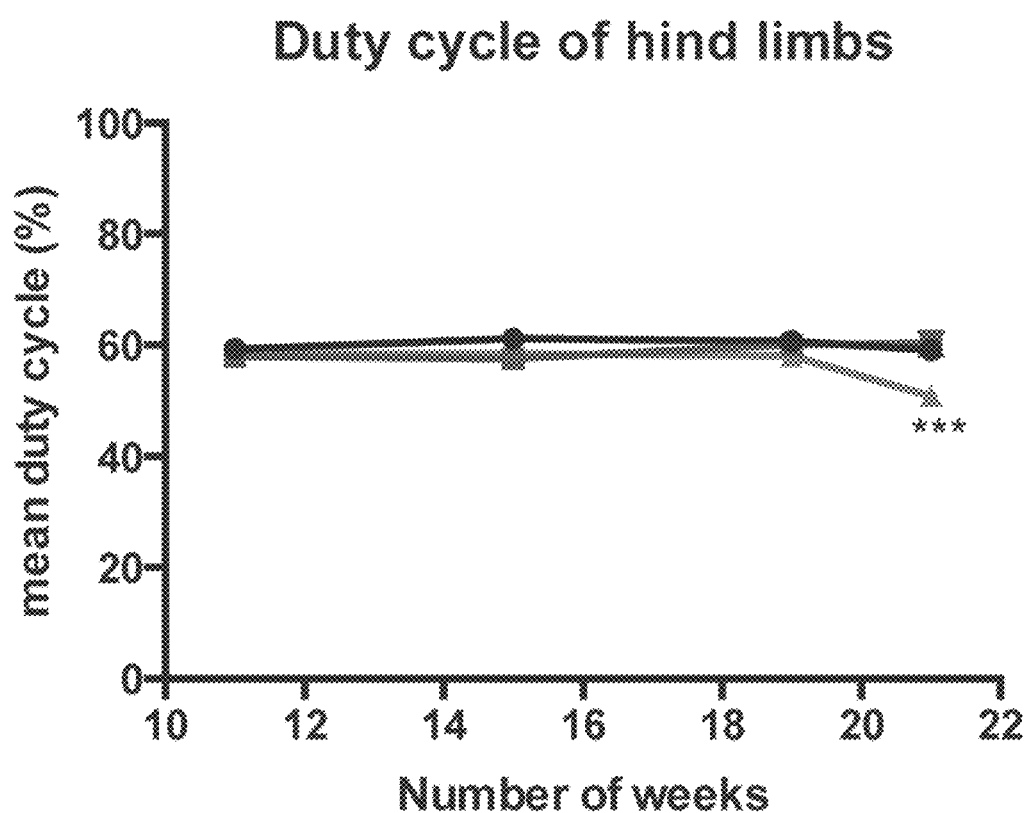
Figure 17U:
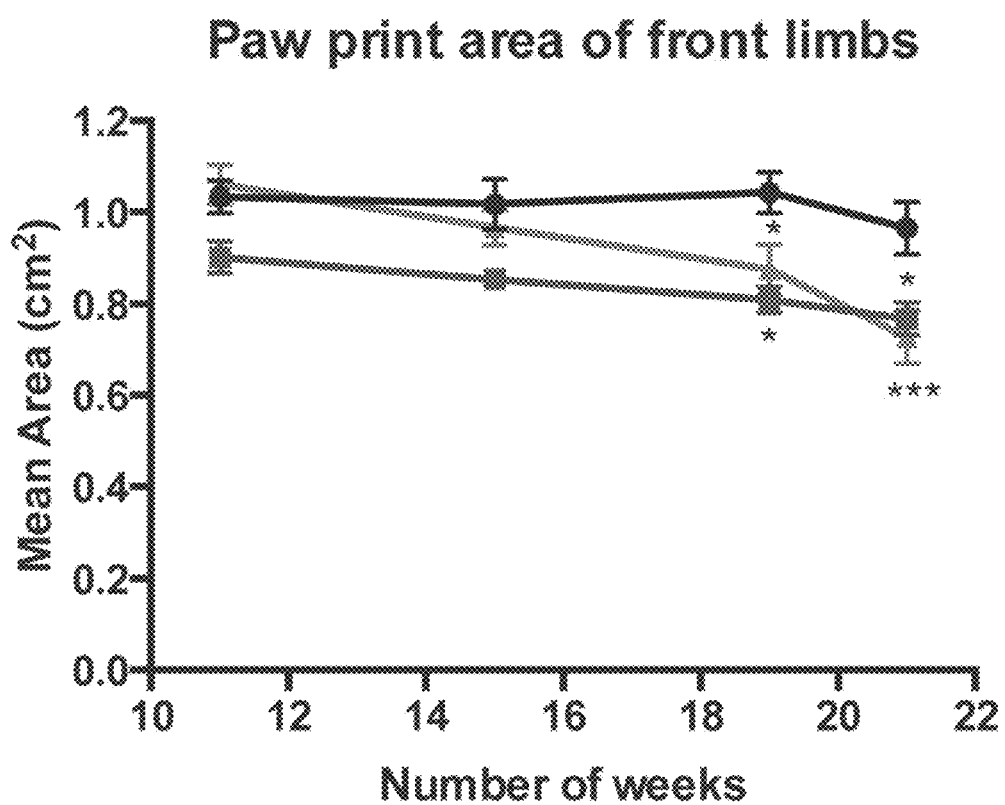
Figure 17V:
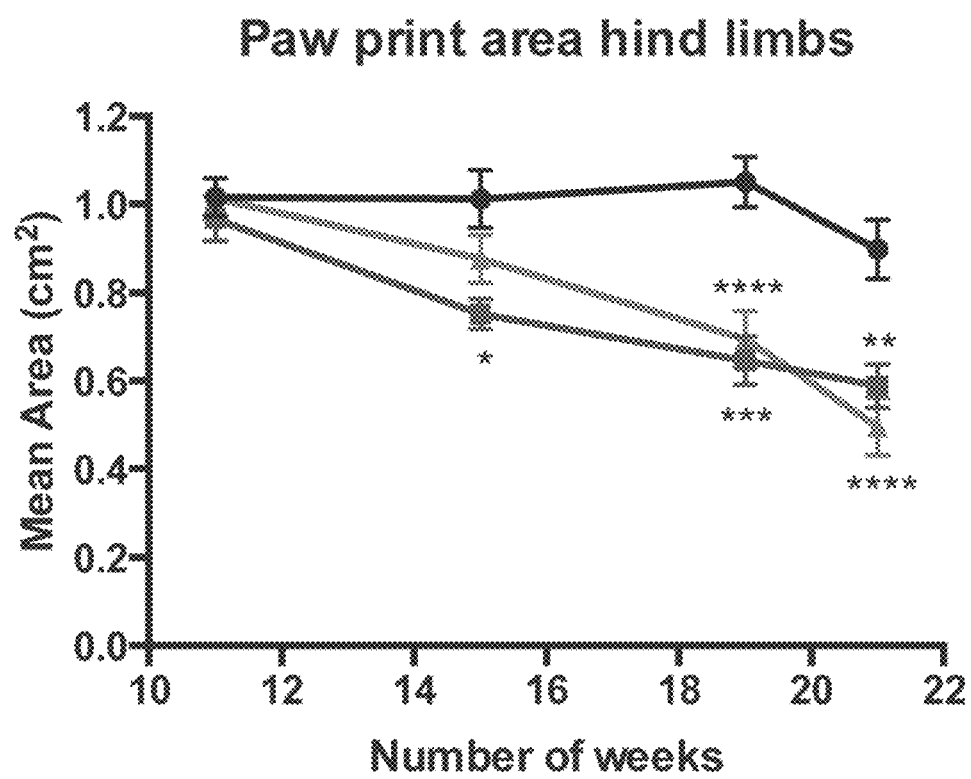
Figure 17W:
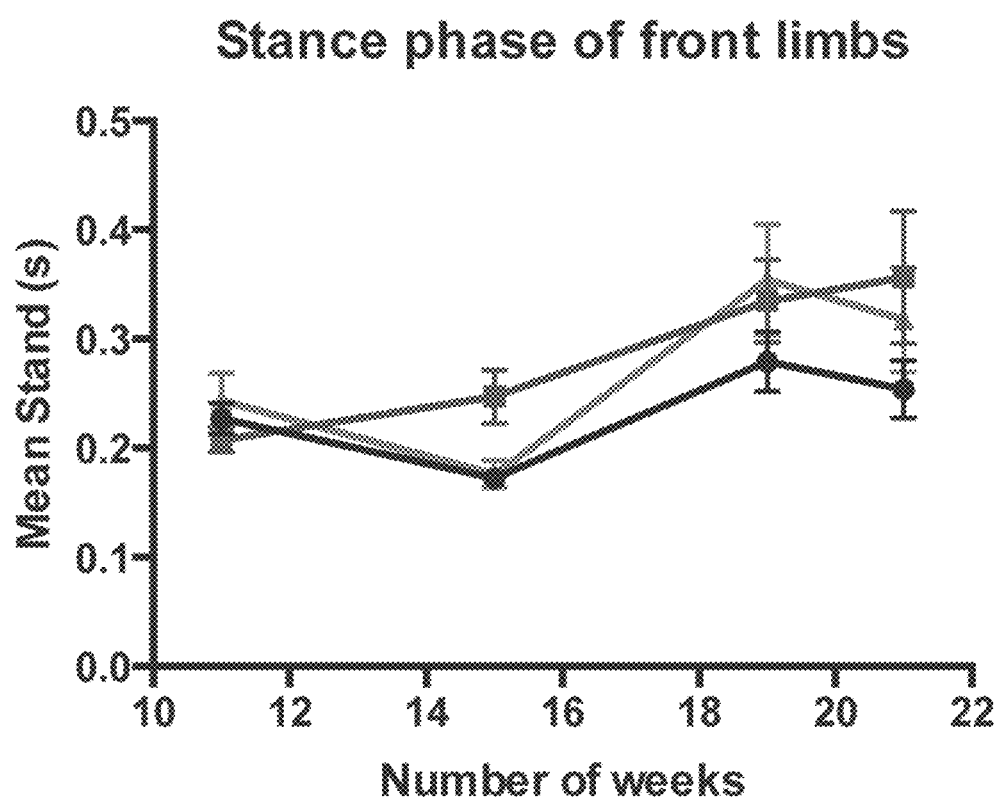
Figure 17X:
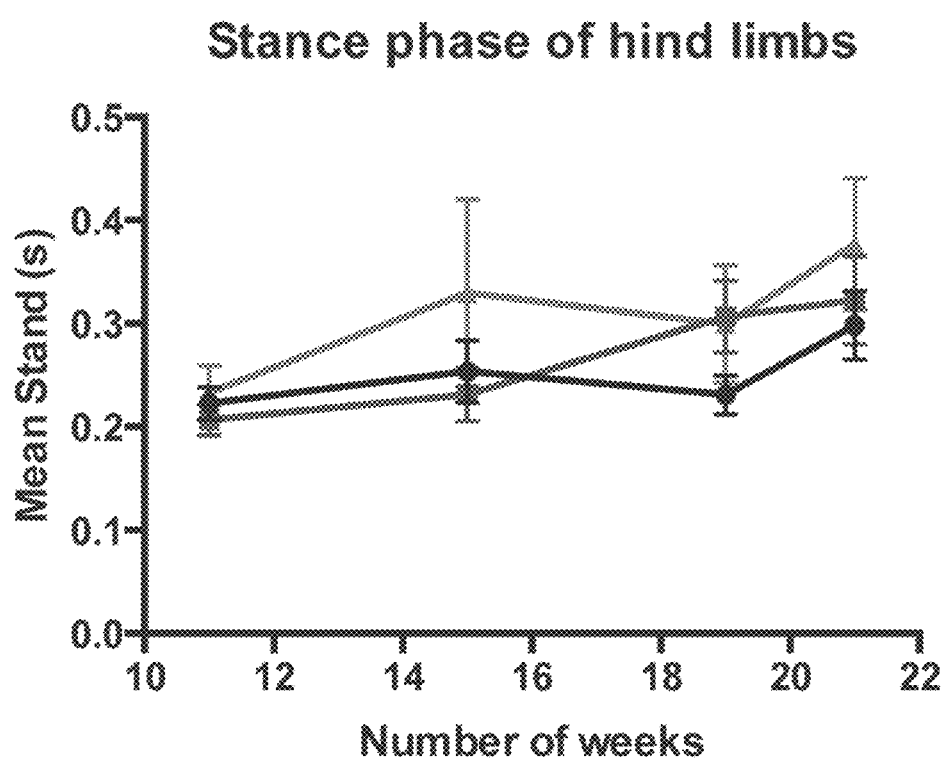
Figure 17Y:
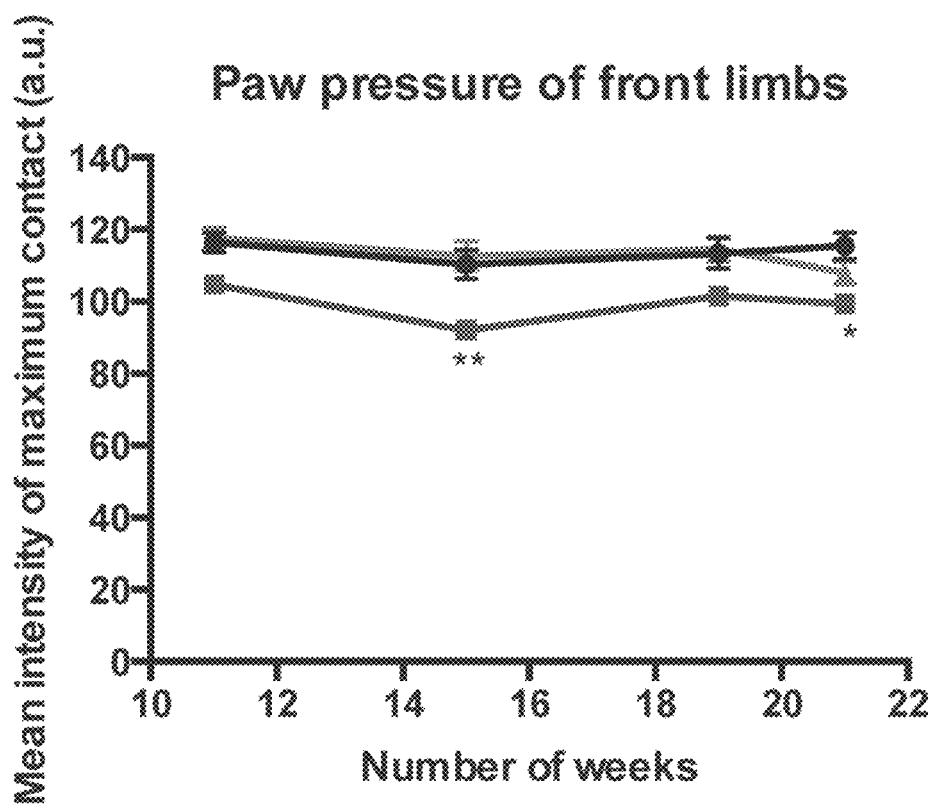
Figure 17Z:
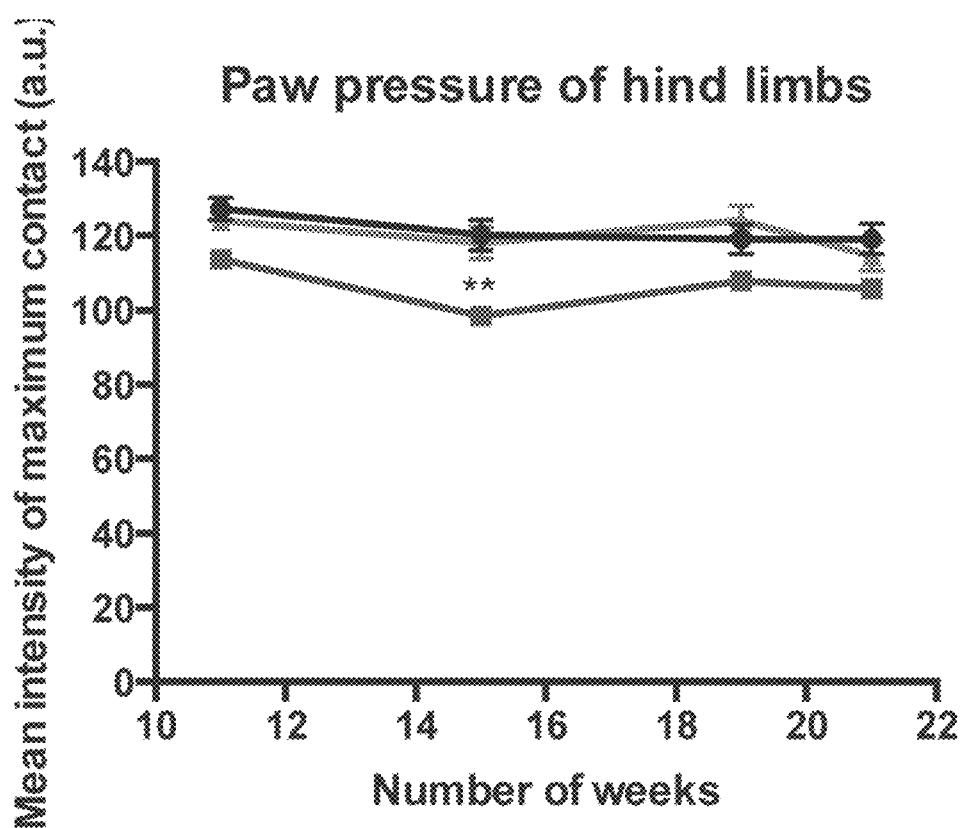

This data suggests that the DR6 mutation is haploinsufficient in mice heterozygous for the mutation. The data also suggests that as heterozygous $DR6^{+/-}$ mice age, the mice will begin to exhibit motor and/or neurological defects similar to homozygous $DR6^{-/-}$ mice in those measurements which appeared normal at first (see, e.g., FIGS. 17O-17P, 17R).

Example 9: Deficient Sensory Perception of $DR6^{+/-}$ and $DR6^{+/+}$ Animals The thermal nociception of control animals, and mice heterozygous or homozygous for the DR6 genetic modification at 20 weeks of age was tested by placing animals placed on a metal surface maintained at 48° C., 52° C. or 55° C. (IITC, Woodland Hills, Calif.). Latency to respond, defined as the time elapsed until the animal licked of flicked a hind paw, to the heat stimulus was measured. Mice remained on the plate until they performed either of two nocifensive behaviors: hindpaw licking or hindpaw shaking.

Figure 18:
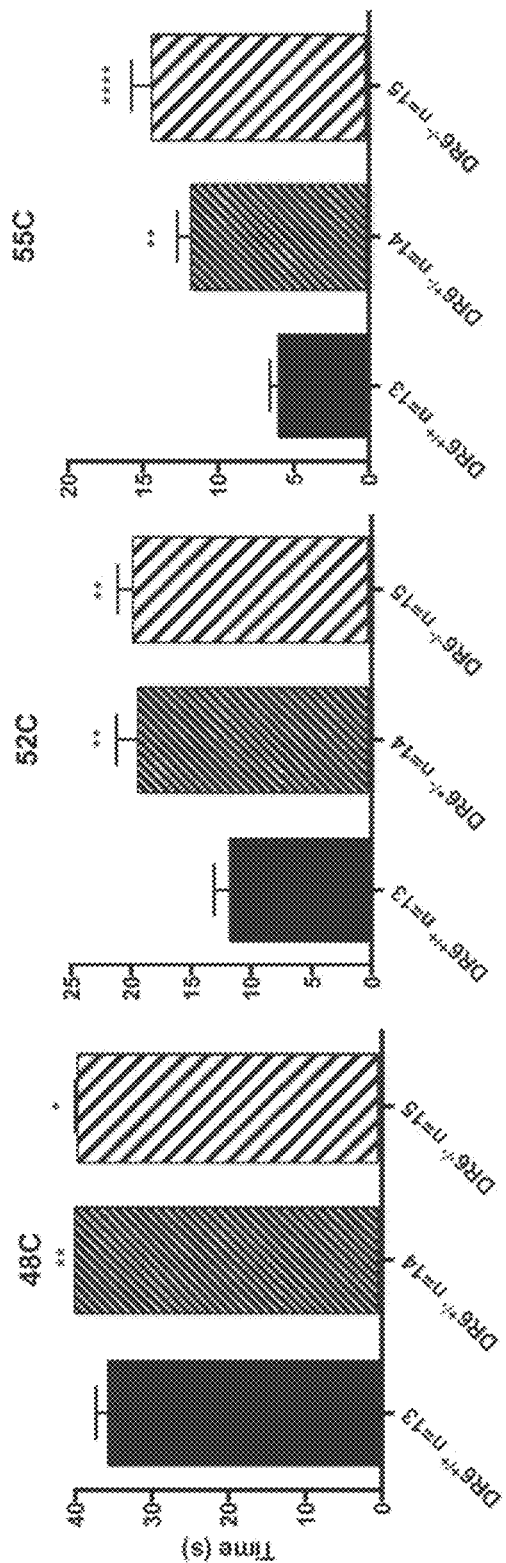
FIG. 18 shows the latency to a nociceptive response (time; y-axis) of wild-type (left bars; n=13), heterozygous DR6$^{+/-}$ (middle bars; n=14), and homozygous DR6$^{-/-}$ (right bars; n=15) animals subjected to a metal plat warmed to a constant temperature of 48° C., 52° C., or 55° C. All data are reported as mean±SEM. Two-way ANOVA is performed for statistical analysis comparing values of wild-type mice to those of knockout mice with * for P≤0.05,  for P≤0.01, * for P≤0.001, and **** for P≤0.0001.

As shown in FIG. 18, both $DR6^{+/-}$ and $DR6^{+/+}$ animals show sensory deficit. The sensory deficit seen in $DR6^{+/-}$ is likely accurate since these mice do not exhibit prominent motor dysfunction at 20 weeks of age (see, Example 8). However, it should be noted that the delay in response in $DR6^{-/-}$ mice may be due to the deficient motor symptoms observed.

The rodents disclosed herein provide a new animal model that more similarly follows ALS progression in humans. Without wishing to be bound by theory, one of several possibilities is that the rodents may fail to show normal pruning during development, and as such, the rodents develop with increased connectivity and mild hyperexcitability, which can lead to low-level excitotoxicity that accumulates over time. Notably, although adult DR6 knockout animals may show increased blood brain barrier (BBB) permeability and impaired development of BBB markers during development, it is unlikely that the ALS-like phenotype of the mice described herein is a result of the role DR6 plays during brain vascular development, as deficits in the blood brain barrier usually manifest as cognitive, not motor, impairments.

SEQUENCE LISTING (17 sequences)

SEQ ID NO: 1 - DNA, 58987 bp, Artificial
  Synthetic
ggtgttccttggcaactcactttttctttttaaaaattgtgtgtgtgtgctgtgtgtgtatgtgtgagtgggtaagtaggtgtacagcagccaggggaggatctcagatgtcttcccctatcattctgccttgtgccttgtgcctttgaggcagaacatcttggtgaacccagagcttatatatgtagacacacacacagatatataaacacattatatgtatataaatatatataatgtgataccataatatagatatatacacaagacacacacacatatatatgtaatataatatatgtaatttatatacacatatgtatatgaatatatatatataatatgctaccataatatagacatatactagacacacatatatgtaatatatacaaatatgtatataaatatataatttatgctatcataatatatataccctagacatatatgtataatataacacatatatgtgatatatgtgtgtgtgtgtatatacatatatatatatatatcacgcacacacacatacatacgtctagggtagcaaccaatcctagtaatcctcctgttttcattcccctcaatggtctacaggcatgtatgagaccacatatggcttttatgggtgtatgtgtgatctaaactcagaccttcacgtttgcataataatcactgttaactgctgagccatctctccttctctcactttcctttctttttgaaaaaaaattttttatacattatgtttttattttattttacttatttttatttttttaatattagatttttttctttatttacatttcaaatgttatcccctttcctggtttcccctccaaaaacccctatcccatccccactccccctgttcaccaacccacccactcgcttccctgtcctggcatgcccctacactggggcatatacattaggttttgagcgaattccaggatagccagggctacacagagaaaccttgtcttgaattaaaaaaaattttttttttaaattagagttgctgccatgagtatgagcaacttaagaaaattatctctcgccgggcagtggtggcacacgcctttaatcccaacacttgggaggcagaggcaggtggatttctgagttcaaggtcagcctggtctacagagtgagttccaggacagccagagctacacagagaaaccctataaaaaaataacacacacacaaaaaaaatcaaaaacaaaaacaaacaagagagagagagagagagagagagattctttccctccaacttctcccagaccttccctacctccattcccaccaacttcatgtttttttttctctctctctctttctcaaaaccaaaaaatgccaggaaagcaacaaaaaataagtagcaagaaagtcagaacaaagaaattaaatacgtaagtaagtaaataaaaatagaaaatcagcaatattaaaaaaaaatcaaggactggagagatggctcagcagttaagagcactgattgctcttccagaggtcctgagttcaaatctcagcaaccacatagtggctcacaaacatctgtaatgggatccgatgccctcttctggtgtgtctgaagagagctacagtgtacttacgtttaataaataaatctttaaaacaagacaacacaaaaatccaaaataaaatttcaaagtgtaccaacacaaaacatgtagtctgttttgtgttggtcaactactcctgggtatttaggcttccttggagtgtggttgctatacccagtgacactcagttaagaaaagtgaatttccctttcctggcagggatcaattgcaagtagctttttggttaggggtagaatattatattccaccttcctgtgctggttccacctgtaaatgtctgtgcagagctgtttatgtttacgtctcaggcagagctctgaggaagatattagtaagcaagacattccttggagagtgcttgggggatccagcaactgtgaaaggaaaaagaaatattaatcaaagggataaattaaccttcaatacagtttcagcaaaggcctctcatggtgctgtccccagttgaggcaaggcaacagacctttttcctcaccaaacactcactggtgtaggggcatggtatgacctgtcatcaggcagggaacattcaccacacagagtggagaggagctgtggccatctcttcaatcagagcagggtgttggatggacgttgccagcctgtaccacccaccattcacatcagctgctctgtgcacacagcacactccaacccacagagaaggtttgtttctgtttttatttttgctttttattattatctcatgtaaaattattatttattttatttttgctttttttattattatctcatgtaacccaggttggctttaaatttgttatgtagtcaaggaggactttgaacttcttccctcacctctagagtgctggggtcacaggcacgtatcactattcctgttcacctggtacttggaatcaaacccaggcttcatgaataatagacctaaactcttccaaaccaagaagaaccacatctcacgagatttgacatgctgtgggtttttttttttcctctcccccctctgtctctctcctcttctgtccctctttctccctcttctttatttctttcatttttatttttacttttgaaaagaagctggcttcaaaattctccatatggctgaggacgacttcagcctttaatttctttttttgtttgtttgtttgtttttctaggcagggtctcactacacagccctggctgtccttgaactcactatgcagactaggctggcctcgaacctggagatctgcttgcctctgcctcctcagtgctgaaattgaagacttgcaccaccaaggtatttttagttaatcgtttgaaaaatttatacatgtttacaatgtattttgatcaaatccaacagaaatcttcctctcacttcttctcagtccccctacatctttcctaccataatttctctctttctcttctttttatttttgaaataacccaccaagtccagatagtactgtctacaagtgcataaatgtagagccatcggctaaagcatggccaggctactagtaatcccactgaacattacacacgttctttggtcaaattaagcaagcttaattttctgttagacagggatagctccctaaatcagactttgataatatagcatgacacttaagagaaagtggggcttgtagagcctccaaaacctgcaagcctgggggttttttaaggcttgggagacttccagaggaattttgattgcataggaacttggctagcagaacatcttatcttatcagggtgcattcaaggtgtgagtcaggctccagagggtggggagcaagtcggattccagaaacacacagtgagtgtttggtgaggaaaaagcacagtcaacctgaattttgcagcagacagaaatgaacttctgaccttataacaaaatggcttccgtccttaagatggcgtcaggctggtccatcagtaactacacccctgaagaaaagttatttcctctccctaactgtcaccaattgccagcaacttctcagctaggaatagagcctcatgatttcctctcccactcatactgggtgttgactggcttgagtgccatgccacgtcctgaagacagcatttcacagcatttgtccctatcctctggctcctacggttcttttgttccctctgctgagatgtaggtaccccgagccttgtagtagaagtgacaggcatgtcccatttatggatgactactcaatggtcacatactctcagaactgtggccagttatgagtctgtgttgactgctgcctactgcaaaaggagtcttctctgggcaaaacagtagtaatctacatgtataaaacacaaatgcttacaaggtagtttgatgggggggggggactgtcaaacaacccttgcacaggggtcacctaataccatctgcacaggggatatttgtgccttccctcagccttgagtaggctaaacaaacccatgatagttttacaacctagctggagtcttctgacctcaccacatttgcaatttcctatagagctttgaggagtagactgcccactgagcttgctttgcaacataatctggctgaaacgaaggatggggtttgtgggctttctcagtgctgaaaattaactttgagccttgatcagaaacgtttgtctttgcttcatccttctcttgcacccagtttttttctcagttccaggcccccccccgccccgcccctttcaggtatacccagtttgtccatggccactggacagctacagatatttacattacgattcacaacagtagcaaaattagttatggagtagcattgaaatagttttatggttgggcatcaccataacacgaggaactgtcttaaagggtcacagctttaggaaggctgagaaccactgtcctgcagcctagctctcatgggtccttgataaggtttgtagcaccagacatgaactttttcctgtggagcagccctcaaagacagtcagaaagagcagttggttatcccaacaaccaacatgtcactattatatcaagggggctttcctatagcgtgaatggtcctcagagggtaagtccatcttttctccccacgtcgcagggatagcatttcctggcaccatgaaagcaggccagtagaaaggaagtttctaaggaccttgtacttctgatcctcctcctcgcatgtgttgggattacaggcctgcaccaccacatccagtttattaggggctaggcatgtgcacagtaagccaacactcaataagcagaacgacactcagacctcagccccttcatttagtgttagtgtgttggtggttgtttattattattattattattattaattcaccacacagcaatttatgtcctacatgtcacattcatttttaaattccctttactttttcccctactttgttttagaatatatgtatatgtgtatgtgtatacacgcacacacacacatacatatatatgtgtatacacacatacatatatgtgtattcatgcatatacatatgtgaatatacacacatacacacgtatatatgagtatacacacatatacatatataatatgtgcgcacacatatattttatatattagcattccagcttaggggcttcagtgtagctcattggcacagctcttgtctagcgttccagttttatttctacttttggcttttaagtctatttgttctattgatttaaagcttacagtacctcggtgggggcacacacctttaatcctagcactctggaggcaaaggcaggtggatctccgagtttgaggccatcctggtctacagatcgagttccaggataaaccgaaagtagagaaaccatgtctcagaaaccaaaagctaaaacaaacagaaaagattcacaacaaatatttttaaatcattacaatatattacaatatcattaatattacacccctttaagggtagtataagaatctttatgttatgtgtctataaaatgggttgaggagctggtgagatggttcagtggatgaaggagcttgttagcaagcctgccaacttgagttcaatccctaggacccacgtgataaaaggagggagtagattctttgaagttgtcctctgacctccacatgtatactatgtcacatgtgttcggcataaaataaacaaaaacatagaagggagcctaggagacagtgccgttggtacaaagcctgctgcaagagcatgaagccctgagtttgagccctagcactcggtcttatgcatacagcacatgtctgtaatctcagcactggggagacaaaagagtgagtggccctggagtttgctgggctgccagtcaagccaaatcgactagctccagatagggagtggggcagagaaagactgagcccatctcaatggtgggcaatgattgataaagacatccagtcttgccttctggcttcccataagtgcatccctcagtgatatactgttacctggaagagtaagccaaccaagccctttcctccctaactgattttggttggaaaggaggccatttccatgaagctaggaattgaccttggatggaagatgctggcggaagtttctggtttagtccaggtggcccccgaagtgtgggctacaccatttcccagaaacctctagtaggcatgcactccagctacccatgctggacactcgttctttgatctctctcgtttactttcttattttccttatattatttgctcgtttatccccagacattcctgggactgtcttttacacaaattcttcacatcccatgatgtctttccggctctccgtcttggaagaaaacacccaagtgactgactgtgaccaaacggttacatgcaaatgtatgaaatctggggacgaatgcagtaataaaaggtgacttaaaggggctggagtgatggttcagtggataagagcactgactgcacttccagaggtcctgagttcaattcccagcaaccacatggttcacaaccatctataatgggacccgatgccctcttgtggtgtttctgaggatagcaacagtgtactcatataaataaatcaatcttaaaagaaaataaaaaacatttcattaaactcgataataggtataaatgcgaacttaatggatgttctcagggaagttgactgtaacttgtaatttgttcagtgaatagcaagcatataacaaccagacggctaaaactaccacaccgctaccacacatgtttctttacgtatcacatctgcatttccccttgcctcaagcatagtacttggaactttgttcctcatattttatgactgccttcatttttttagaaaagagttgttactattattatatgtaagtacactgtagctgtctttagacacaccagaagagggcatcatgtggttgctgggatttgaactcaggatctccagaagagcagtcagtgctcttaactgctgagccatttttctagctcaagtgcctttgttctttttctggagtttctggatctagacagtgtgccttaattttgttcttcagtgatgtttccagcctgcaaccgagcttcccttcctcggctggaaacccatctttgccttctagattcctgaagaggttgaatttcatgtgctgactacaggtcccttcttcaaaacccattctgccctcagaatctatgaacccgatttaaaaaaaaaaaggatttttatttttatgggtttggctattttgcctgtattcatatctgtgcaccacatgcatgaagtgcttgcagaggccaaaagagggcgccagatatcccggaactggagttacagatggttgtgggccagtgctctggaaaaacagtcagtgcttttaacccctaagctatctcaccagccctcatcttctcttagaccgagtgctagggctcaaactcagggcttcatgctcttgcagcaggctttgtaccaacggcactgtctcctaggctcccttctatgtttttgtttattttatgccgaacacatgtgacatagtatacatgtggaggtcagaggtcaacttcaaagaatctactccctccttttatcacgtgggtcctagggattgagaagtcatctgtgatttttgacccagctgccctacctcattttgcagggaacagggatggggatgggaatggcaaagggcaggacactgttccaccttccgcctcaaggctgttaacaaggtggtttaatactgaattgccagcccagcccagcccagcctttcactattttcccggtattgtcaaacatttcctccacactacctatagaatattcttacttatgtttaatgatctactttagtgtttattttaagtacatactatgttccgttccttgacctcgctgtactttgtttattcgtaaatatacttacccacctgttgtaataaaaatgtccttctgtccttccttcctttcttcctttcttcctttcttccttccttccttccttccttccttccttccttccttccttccttccttcttttctcccttccttctttcctcccctccttccttctttcctcccttctttctttcctcccttccctccctcatttctttaacgttcaaccaatgtttctttctcacgtttcctttccaaggtcagttccgagggctggacaaccacactaagctcagcggctccgcacatcctgccctcgtggagcccatgttaaagagaggttggtggagacacgcaatggacactggagacaacgacttagcttagtaccctaaaagtgaatggaggatatgcaaaaataagatagaggggagagcaaaggaatttggcgtccagcgttagtgtgtgtgtaggagtgcgtagtaaagagcagaagctcgttacgtgtgcagcggatgtgagagtctcacagagggaacccccagcgctaagttcctgaggcttggtgggtcaaagaacaaattaacctcagcatagttacccttccataagcaacaaattctccaggtccactaagcctcgtgatcagcagcctgtacagtcacttatgaggaacttttatagggagaacaggatgtgatggtgtatttaaacatatgtatttaaagatggctcagtgaataagggtgcttgttgcccagacctgagttcaatccttgggctccacgtgggggaaggagagaaccaactcctgatcctccacatgaatgctgacatgagcatgcacataagcaatacatgagtctaattttaaaaaaggaaaaatacctctggttaacatataataaattgctattcttttagatggttggattcctaatacacaccagcacagagtgaacgcactgggtaatgtacaatagcaaggtgacttacatcaaactacattaaatgtttaaaacagtgaaaacctgaaaagctaacatttttgtccaatgtgaaaaaaaagtcttatttagtagcatgatatacacagaggtaaaaatagatatcagaaagtcccccacatatgctaatcaattttgttcttaatctttacatatccacttatttttgtgatatctttattttatgcataagggtgttttgcctgaatgtatgcctttgtaaatacttgcatgcagtacccacaaaggccagaagagggcgtgagatcccctggaattgaagctactgatggttgtgaaccaccacgttggtgttggaaatctgacccaaatgctctgcaagagtcgccagtgctctgaaccatgtccaagttatctctccagcattatatatccacgtttgaagtagaggtacattgggcttttcatttttatagtggttacttaaagcatagtctatgctgtttttaagtgacagaatgttgttcattgtatttaaaaaatatagacaaaaatttaaacactttaaaaaatattatttttctttatgaagatacatgcttttaaggggttctgttggagaatttcagtagcgccaacttaaaacaaatactttattagggctgtagaaatgacttagaggttaatagtgtgcactgctcttgcagaggatccgagtttggtccctagcacccatgtcaggggcttacaacacaacctcctgtaactgatgctgcaggggatcccaccccctcttctggcccctctcatgcacaacacacatgaggcaggcacagactgatgcacatatatgtgaattaaaccccaaataaaatcgttttcaaaagtccaatgaatgtcttgacaatgcttttataatcaattcattcatgacaggtggttccctgtgtttgtgatttctcttcaagctgcgcatcaaagcaacccctccttctccctccttccctccctcctcctcctcctcttcctcgttctcctccctctctctgtgcatgtgtgcctgcttacctgtttgcgcaccgcaggcgtgcaggtgcccacggagtgattaatgaattctttggaactgggttacaggcagttgtgggcgatgtagtgtaaatgctgggaaccaaactcgggtcccttggaagagcagcagtgctcttcacagatgagccatccctcaagtccccaagaacttgtttctcttgctcagcttgcactctccaagacttaggaaagtgcttagtgaataagctggggcacaaaagatgcggttataagaaggtgacgtaggagcctctggcaagcgatgcagatgccaattctcacttgtgttccggtccctctcgcttttgtcagttttagaatgttctaggctgggtttggtgctgtcgtagcacagagaggaaacagcatgaaggacaaccaggccagagatagttgatggtctgagccttttgtttgctggcttcactcgctccgctgttctaaagcttcagtcaatgggtctatgttgaaccagtttccgctgttcactacaaagatgcaattggaagccgagggagggagggagaagctctggagagtatggctcagtggttaagagcactgactgctcttccaaaggtcctgagttcaaatcccagcagccacatggtggctcacaaccatctgtcatgggatctgactccctctgaagacagctacagtgtacttagatataataataaataaatcttagaaaacaagtagctgagggaggagttttttacttgtctcatccagggtgcctggaggatgacggcgaggcgccactttgcttacctcaccaagtgagagggacaaaacatagttttgatctgcagtagcttcgcggtgagcaccacatctccacctagtcctccgctattgtcggctgctatgaacagaccctgctgtcacctggccatttatctccatggtcctgtttaagctctagcctattgactaaggggatgcaagttgaagtggatgtccccacgtttgaacacagcactacatgctggtatctgaaatctgagtcacatctaggtcagtcacattttctagatttatgagtctagattttatttttccaggtgtcttgtttttctgtctctaaatgatgacatccacccccctgccttcccccccccccccacacaccatataccctgggtatggttatttgtagcaaaatcaatactcttgtacttgaataatttttttctttgcattttgaaccaaggtgtttattcacaaaaggaagaattgtccatttgtctgtctgctcagtctttggcttagcatagggcatgtgcagaggctcaataaaaatcttttgcctcaatcagtacatggcacatgcattacctcagggtcatatttgtaaataggtatgggtgtttgcctacaggtgtctgtgcaccacttgcatgcaggtgcctgaggaggccagtagagggcatcagatctctgggaactggagttacagatggctgtgagtcaccatatgggtattgagtacaagagagactctggaagagcagacagtgctcttagccactgagtcatcactgtagcccgcatgccatattattaaggaggctgaacaccaagtgattcagcctcgctacagacaagtagaaacctgtctctggcctccttaaccacaaagttggggggcttccctcgacacagaagccagagaaccatttgacaccgttcctctgtcacaggctgtatcattggtccattttccacatgacactgtgcattcaagcattcatctctgcagatccctgggcagtatggcagtgtgtgtgtgtgtgtgtgtttgtgtgtgtgtgtgtgcttgtgtgtgtgtgtgtgtgtgtgtgtgtgtgtgtgtgtgtgtttgtgtttgtgtgtgtgttctaattggaaaggaaatcttcacttgcctttaaagtgcagtgctactatatttctttgcaaatatatatacgtatatgcatatgtatatgcagatgtatacacacacacacacacacacacacacacacacacatatctcaaagttcctttcaggctgaagaatccattattgtcgggccagtgagatgacagagcagtttaaggtatctgctgccaagtctgatgacctgagctcaatccctgaaatccacaccgtggaaggggaaaactgtctcccacgagttgttttcttgaccgccacaggtgtatgcaaatatgcatgtgcacgtgcacacaagcactaaataaacagaaagtttaaaaaattaaggtatatattatttactatgtaagagaacatcaaaaaagtcttgagaagtacaccatgggagaaaacacacctagcccttcaaataatttgcccttctagaaaaatcctgaaatagccctttccccatacagtagtagaatgataacattatctcagagatgagcaggcgtttaaggctcagcggaacgggaagagagttgggtttttcttcctatttgttttgaatagctctgctcccgggtcctctgcttgcccagatgatctgtgaaatgggtgagtgagcagcgcacctccccagcgcgactgttactgacgtcagcaagcctcattagctgctgtttgtctaaccaaagggaacagcgggtggagagaatcttaatgacctgacttcccacactgcaggtgccacttgcctggtgtgcacgctgagattgcatcagctgactaggcaaacaaggaacagtggaaatgggaggcagagaaaaagcccaagagagactgcccagtgagtggaactcgctgctccatcctgggagagtgtagcagagatgtttgtgcgtggtggagtgaggtcgactcaggttcacagctgtgcgctgctacatagtagttgagggtcgaatcacttaaaggctttagtcccgttttcaaaattaaaatagggataatgatagaaccttagggagaaggagggacacgtgtgtaaatcacagacctcattgtaccactggataactggcaggagccactgtttctgactctacagtggagagaagggaagagcaatgattggcactgtggacgcaggtggcagagaacagctaaagatgactttatatcctaaaggcaagtggggtagctgtgagttttaaagaccgaaccttgcttcacaaaattgctcttgctttcctacctaccaattctgcgttctttctttttccctggcagcatctccccggcggactcagccttggctacagcggagactcctgggaaggaaatgtccttccccagccctaggcacagtggttattgtctgttctcacatcctgtgagccctgtaggcagaggaatgccccagaaccacagcaactgtgcaaacatttgaattcccacgggtagtttcccatcctcgtacccatgaggcttctgctctctgtagtcagaagaacgtacacagttctcaggagcaggaagtagagggctaggaatcatgggtgaggagcctagcatgtgtgtgaatacatccgtggaaaacgtttttgagggagatagtacagaatcctactccaggtgaaataatgagactcttgctaagaccacgtacggatgacccaatcaatacacaaggagggagttgaaaaggagaaaaggggttggccattaatttagccaacgtataattccacgtattagcaagtaactttaattatcctatgcgccctcggttttattctccacagctgtaaatggtaataataccccctttgaacatttatcatgattaattaaggcagtgttgttgaaacatattgaaagttacctaggctaactttgtccaatttgccagctgctttggcaaatcctctgcactggggctggctcaggctagaactatcttccatctgggtaaatctcttctccattccagagcagatatcatggcgggtagcttgacctcacagtcatgagacaactcaaaccatggggattggcaaatgaagcaagtccttgttattgaactctccactcagaaaaaataaaaaataaaaacatattaatactacggaggattccagtgacactcccttctgggaaagacactcaagagatttttatgagcagtcagggcagatggaagtcacaaggcaaacacctcaaagtaaaaaaaaaaaaaaaaaagatcaacataccagagcactcaacaagctgacagtctggctgcccatgctagatgcttagaatacatgaatgacaaagtttgtatgcagtctctgcctttagggactttactgctaatgggggattgtttatcaaacctaaataatatccttgagggaatattactatactgtgggtattagtgttcttaaccaatatgggtgttgactttgtctgtgtctctctctgtgtgtgtacaacgtttgggagtcaattctgtctttccaccacatgggtcctggctatcaaactcagtctctcagcattactggaagatgcctttgccccatgagtcatcttgacagcaaaattgggtattgagaacttgaaagtttgctgtgtgaagaataagtaaaacatgctaaaaaaaaaataaagtagacaggctgcacagatggctcagcagttaagagcactggctgttcttccagaggacccaggttcatttcccagcacctacatggcagctcacaactgtctgcaacttctgttccaggggatccaactccttcacacatgcaggcaaaaacaccaatgtacatacaataaaaataaataagttatataaaaataggcaatctcatagttttaccatgttaattatatgttaaactagcaatgtgcatatattgcattaaataaaaatgattccttaactaaattaatttctttaattaaataaaatgcaaaaaaatgaatgaaataaaatcactttcacaaggtggagaaacactttgggaagacatccagatgtgaacctcaggcctccacatacacaaacattaataagtatgttaattaaaattaatttcactttacttttaaaaatagaactactagattgtttaggatagaatatataacttctgcccaatatttgctcatattcttttggaaaatatgtgttcaaatcctttgcttattcttaaattagattgcttgcttttattgttgtatttttttctatcccaaatagccaaatagtatatttgtttggaggtgtatgtggctgttttaagacaggatttctttttctttttcttttttttttttttagctctggttatcctggaactcactctatagggcagattggcctcaaattcacagagatctgcttgcttctgcctcctgcatgctagggttaaaggattgcactggtgctgggcatgacaacccccccccccctttttttttaaccttcactggtatagtacaaatatggcacacagaccattcacccatacacataagagaaggactaaacaaatatgtttaaacattaaaaaaaaaaaaactattggaaacggaatcgtcaaactggaatggtggagatttcatcagaactggctttgttcattttcctgtctccgtcaaactgtctgctctgtcacagtctggttctccaccacgtggctgctgcttctgttggttcagatccctgctccgcagtctgagccaatgaaatcccggctcttcacaaaggcggttttagtggcaagtctttggggcttcttctgttctcttggaagaatggccccagcagcttcttccatagcgcttctggtgaaccagatggcatcttgttcaacctcttactgcactgagcacgcagcctccccttacaagattcataccaatgtctcattgttttccaaagtaacttgagacttgaactttcccagactctcaaataaaaccattccttgtggaagagtgcggtggtctccagtctttagagactgcctgcctacctaagctttaggggacagagtgggacaacactaacaaggtgtgtgggcatgacaacctctaatcttctcagctagcttcacctggaatctcagtcttatgagtaatctggactaacagtaagggactcattatttgatgcttgccacatctggggtcaaatcttggcccctagaaatgggagatggatggacaaagatgtcctatacctttagctataccttctaagaattcagcctcaacagcttggagacagacgggaggacaaacagggtgggcttccctggttgctgggcccgcttagggcttggctgtaggctgaaagggaagggagcttgctctctcggccacacactgtacttgcatctccatcgctgggatgcagacagtgaagagaacagaccgtagctctgcttgttctgagacataggaaagcgctccaacaaatgtttcttcacctatcgtatgctctgaggacaatttccacagactctagatgatcatcgttgcacaatttttaggaatcttcgcagtttccttgaagtgtgtcctcaagagttcctgatgctgccgttatagaagtgggagtagttgggggttttatagacaaactctaaaactaaaagaaggagatatacacagttacagaagtgtttggtcagcaaggagtcaaaaaattagccagtgcacactaggcagcatattaaagtatataatatagtatatattatatactatatatattataaagtaatgtattacaaagtaatatattactatatattataaagtaatatactataattaatatataagtaatatactataacacatataatatataacaaatataacatataacatgatatattatattatattatagtatagtatagtatagtatatataataagatactactggctactaatccatccaaatctagaatgaaccctgtgtaaacacacaggaaaacagtgggaaatctagtagaaaactggacaataggtattaataggaaattcacagaaggcaaaacttttcaaaatgacaagttcatgaatggggctttatcactattaaatcctttaaaatgcatttaaatgccaaggcgatggctcagctgttaaagagcttgtggggggatcaggaggaccagagattggatcctagtatctgggccaatgtcagaaggatgtggcagcctgcctataatgctagctttggaaggtggagtcagggtatccccagaacaagctggctcgtgggattagccacattggtaagctctgggtttaattgatagagcctgaatcaatgaagggaggagagagtgacacaaagagactcctgatgtcaacctcaggactctcttcatgtatgtggacacatgtgcatgcacccacacacacgtgtgtccacatatttgaaaacagatatttacatacaatacacacacacacacacacacacacacacacacacacacattcaaagtaagtaagtgcataaaaatggttacattgtagcagtttgtatatgcttggcccaagggaagtggcactattaggaggtgtggccttgttggaggaagtgcatcactgtgggggtgggctttgaggttcttttttccattttctctatttgatttgattactacagccatgaaattatgatgatctacatatacagattttatgacaagaaaagaaaaattcataaaaattttgaagctggagcagtgattctgttggtaagatgcttgtaagctctgggctcatatccacttatcagtgagtgcatatcatgtgtgtccttttgtgattgggttacctcactcaggatgatgccttccaggtccatccatttgcctaagaaatttcataaattcattatttttaatggctgagtagtactccattgtgtaaatgtaccatattttctgtatccattcctctgttgaaggctttgaggttctatgtttaagctctactaagtgcagaagaaagctctcctggttacctttggatcaaaatgtagacctctcagctccttctctagtaccatgtctgcctgcatgccgccatgcttcctgccatgatgataatggactgaacctctgaacctgtaagccagtctcaatgaaatgttgtccttcataagagttgccttggtcatggagtctcttcacagcagtaaaacccaacaaatatcactaagcaatttttaaaaataaagctaagggctagtgagacggcttggcggttaggaatgcccgctgccaagcctgaagacttgatgagtttagtttccagaatttatatggtggaaggagagaacaaactcttagaactgtcttctgaccttaacacacactgtgtgctacactcacgcctacacaaatgcatgcccacgtaaacaaatagatgcgaaagtcaatgtaaatacaattttttaaaaaaaaatgaataacatgcagttaagatgaggtcatattatactctcaccattggacaaaacttatatgttattgtcctcatttggttctgttgctgggataaaatgcagaccagaactaacctgtggatgaaggggttcattctgtttatagtttatcctccttcactgagggaaggaaaggtctacatcacccagaggaagaactgaatgaagcaaagaccatggaggaatgatgcttactggcttgcccccaggctcagggtcaacgacctttctcatgcctcccatagccacctgcccagggatggcccagctcacaatggcctgggtcctgtcacatcaatcaacaatcaagaaccttgcctcacagacatgcccacaggccatccctcaaccaagatctctccctcccacatgactacagtttgtgtgaagttggtgaaaaccagctagcagtttatcaaatcttggtgggaaaaagatagagagacagaactacgctttgaggagcaacttggtggtactaagtgaaattaagtatatataattatggctaaggaaataacattcttgggttaataccttagaacatcttccataaacaaactagaggaaggtaatttaaagcacaaataggcaactaataccatcttaaactaacctacacacctacgggttatgaatggtgaccacaggctctgtatgtctactaagaaataactatgtgagtcaaaatgaaagaaccaatcgatctacatacgccagcaaggacggtttctaactgtgcttcggatcgtaaagataacaaagcaaaattagatgatagcatattaaaggttatgtaacatgtgaatataatggtttctgtggttcattgttacatccgtttatgaatgaagctgtggttggtgaatggtatgcattaggataataagcgtgggtacctggtaagagaagagatgaaaatggctggaggaggcagtgattacagttccattcagaagggaatctagagcctgggagatggcttggtaaagggcttgccaagcaagcatgaggatcgaagttcaaatccccagtccccgtgtaaaaagctaggcagagcaacacatgctcagagccgaggagtcagagacaggcagatctctggagtgcactagtcagctgactcagctgagtccctgcactccaggtttagggagacactgtctcaaacaaacaaacaaacaaacaaacaaaacagctggaatgtatgctgacttagttttacttgacatagctagagtcacgggagaagaggaaacccccaattgtgaaaatgcccccactagactgacccatgggaaagcctgtagtgaattttcttagtgactgctgtgagaaggcccagcccagcatgctgtgagtgggttgtcctgggtgctgtaagaaagcagactgaacaagcatcgggaggcaaaagctgataagttgtcccttcctgtctccaggttccttccctgatgtccttcactgatggagtgtatctgagagttgtaggctgaagtcaaccctttcctccccaagtagacaggaggttagaaagatagccctgtgggtcagagtgggtgcggtacaaataggaggatgcaccttcatatctcaacctttgcatgagcatctgggtgtagacacacttatgcctgtgacacctccttggaggtggtgatcgtgggactgactggccaccagcttagtttcaggttcaataagctaacctgtctcagggaagtaagatgaggagtgagagagtctggaacaccttctctggcatttgcacgcacatatggatacctctccacatgcttatacagtacatacatacactccactggcatgcacacgtacacatgcacaccaacaacaaaaaagtaagttgaaaaaaattaaagaaacactccatgttaacttatggcctttacatgcatacatatatatgtgcacacgcacctgcatacacttacacagagggagagattacataggcgttgtcagcagtgtgctgcagacaaagaggtatgatcagtctttctgagatgaatcttagtgatgaggattccatgatgtatgagcaacagggctgggcagtgcagccagctggtgctgcatctcctttcagtttggattatcttattgggtcacaccagaaccagggagataaatagtcaagacagactttgaaaattcatacaccacacacacacacacacacacacacacacacacacacacacacacaccaataaagctaggtttgaatgaattacttttgtaaaatccaggtctgagttgtattctgaaagctttacttgtttggactggccagtagctcagtcaggcaaaaagacaccacacgggagggcagactttaaagaagaacgtttcaatgaggcaagctgtcacggcttgtgtgaattacacaatgaaagggaaaataaaataaaactatggcgggctaaaatctgtaagttctgacatgtggtcctcgtggcaccatctgctcatgaaagcatgaagaggcttctggaactttccaggactgggttgatttgtctccacaaagctgcctgggtaagaccctgtggcactgggtcatcaagaaggtactagcagacttcctttttatctcagtatttttctacgtcagtccccaaaccatgaaacaacagggcttaccctgccacaccaaaggtcaaactatgttttctcttacccaactattgcctgggatggctccaactttattactaccccacctccaacccgtaataactctccagctctcacttcaaatccaagagagtgtggactgagtgaggggaccagagacaggtgcatctggtagaaagttatactcaattaactaactgaatgcatttgcatgtggttttaattccactgtgcagcaatttcctgagtaaaaatggagagattatatctagtttttgagtcactgtaagaattaagtaaacgtagctctcaatctatatctgcacattatttttcctcgtggtcctagatttctcttgttcctgaccatttgtcccgtcttggaatttccccagccttcagaggtgtagccctataatttaccgtccagattgcaatccctcttcatggcatgaattaagtcttatctcaccaggaagtgctctttcctttcttctgactcctctccctctggctttcctcttcatttcttctctacactgtttagggaaagaggtttcttagcaaatcctcagacaccccaactagtgggcttcccggaaagtctcagccgtgtgtgggaggtctgccctgaagaagttctttgccagaaaatgaagcaaggtgttctggctggacagtgagggtggtagactgtaataagtatgtctggctttaactcttctatattcatctgaggggagcatctgagcccaacacaacatctccatcgtcaatggagaatcctactcagctgacaaggcccttgcttctgtgttgaaggattacagcaatggcctcctgtttattgacctcatacttagacccatgaggcatgcatatcatagtttatttctcctacttagcaactgaaaatactaaagggagtcacagagtctgactgctctcacggtctgtatctattgcttaatcgaaagcttccctgttaccctcccatagcaaataagggtccatcccacaagacactgtggaaacgcctcctctcaagctcctccagacctcgcagtgagtcaatagagagcagaggggtcttacgtctctggtgcctaaagaggatggggtgggcgttaggtctcagcaagaacatctcttcttatgtggccagcggagagcccagaaatcttaagctttttcataagggtttctttgagacgcttcctaacctagtgatccggttatcaccaagctaagggaaaacgatcacgtgacacgaaggatgaaggaaaaccctcagattcctcctcctctgaatctgggagtggaaaactgaggagctgagctcagagttccagagccacgcgaagctgggctcagcagtgtttgcagctgcaggtctggtgagcctgtggaaagagagaagggtgagagaagagagtctccaaaaagctgcccgaattagagaaacaagagaccctgcctcaaaaaggcagacacctcaagtggtcctctgacttctgttcatgtgtcatgacacgagcatccctgaatccacatacacagctgagaagcgtgtacacacacacacacacacacacacacacacacacacacagagagagagagagagagagagagagagacagagacagagacagagagacagagagacagacaaagagacaaagagacaaagagagagaaacagagagtggctgaagggagggggcaggggaaggagggagggggagggggagagacaaataatttataaaaggaaaatcatttaaaacatttcagggctgccgagatgacgcagttgcaagcaggaagccctgagtttggagccccagaacgcatccaaaagccaggtgtggagcgtgtgtgttctgtatctcagctctggaaacaagggcctcgccatctattgccaatgggctgccaaaccaacaaggagcgagcaagccccacttttcacgtaaaatacctcaaagagaaaagcaacagatgcaaaggggagagaatctcgcttttgcccagatcatgtagcagccccgctcttagaggacgtactccatgtctatgtgacttcaactttcaattctacaaaaagggttggtttcatccctctcttctcaatctggaaacagttcgttttaacgacagatgggtgatattacacttagaatcaaactgttaagccatgtgaatgaatttatggtcacgtcatttcgaagcgtcccctctacaacccccctccccccgctgggaaaagaggggcttcccgctttcccaggaagggaagctgtgggctctgctgggggacacacactgagggactttcatcagcatccctcccaagagggaagggacatgtctgtgggccttatggtcttcaaagggacgtaaagccgttgcattctgattagtttgtggagggtacttgtttcaatccagctacagtttggtttgtgcagctggtatctgctgagcagctgccgggacctgtgtactctcgaaatcggtgaggctaacccctgagaagcagagggtcgggtgtcacgagagacttttctttccctttttggcagccatattgaaagattcacagacacgctcttaacttatccatgcaaagtgagactctgctcacattccctgatactttccttcaaaatgcaccaggaaatgtcaggaaataattcaattagtctcaggaaatttacaaactgtgcaaaacgttttgaatccacttttagaacactttcaatgaccacaaaagctgaagaaagggcagaaagaggcaagggaaagaggaaaggaagaaaggaaacaaacaagcaaacaaatccagtttgtcttcagaaggattatgttggaggttcgttttgcttgtagagactagttcatctattccaggcttgctttgaattccctgtataatggagacaggccctcaacttctggtccttcggcttctgtgtggcattacagttgagtgctatcacacttaattatgtcagaggcgtttttgtttgtttgtttgtgtttatgttttactttagcagtggctggagttggggtggggttgggttactccagcagctcccaagaggatcagcctttcaggctgtcgctggaagggcagctatatagatgctgcaagaaaagcaactagctcctgctcttagagaacttttgtttattattattattaatttactttatttacatttaaaatgttagcccctttcctggtttccccttcgaagaccccctatgccctctcccctccccctgatcaccaacccacccacacctgcttcctggccctggcattcccctacactggggcgctgagccttcactggaacaagggcctctcctcccattgatgactgactagaccatcctctgctacatatgcagctggagccatgagtcccaccatgtgtactctttggttggtgatttagtccctgtctgggggtactggttagctcatattgtttttcctcctatggggctgcaaatctcttcagctccttgggtactttctctagctgcttcattggggaccctgtgctcagcccaatggtaggcttcgaggaaccacctctgtatttgtcaggcactggtggagcatctcaggagacagctatataaggctcctgtcagtaaggtcttgtactcagctattaaaaagaatacatttatgaaattcttaagcaaatggatgaaactagaaaatattatcttgagtgaggtaacccaaccacaaaagaacacacaaatacgtggtatgcactcactgataagtggatattaggccagaagcttggaatacccaagataccattcacaaaccacatgaaactcaagaagaaggaagaccaaagtgtggattctttgatccttagaagggggaacaaaatacccatgaaaggagttacagagacaacgtgtggaacagatactgaaggaatgaccatccagagactgccccacctggggatccatcccatatacagtcaccaaacccagacacttttgtggatgccaacaagtgcttatggaaccttttatctatagagaaggtttctcagctttggtagcattaattaattcgttgtcatggaaaggtgccgtttacaggcatcccttcgcctctccctgtagttgccagaaacatcttagatatggatcaatatcttctggggccaggagatattcccaaattgagaaccattggtcagcactctgtctatcatgactgcaaacaaattgaaaacttgacaaacattaatgaaaacttgataaacattaatgaaaagaaactcagaaaacactttgatagtattttctttaagacatgccatgcgtggtggcgcatgcctttaatcccagcactcgggaggcagaggcaggcggatttctgagtttgaggccagcctggtctacagagtgagttccaggacagccagagctacacagagaaaccctgtctcaaaaaaaaaaaaaaaaaaagacagggtctcatgaaacccagactggccttgaactcactatgtagctgtactgcctgggtttgtgtgtcaacttgacacaagctggagttatcacagagaaaggtgccttccttgaggaaatgcctccatgagatctagctgtaaggcatttttttcaattagtgatcaagggtgggagggcccattgtgggtggtgctggactaacctgggctggtagtcctggattctgtaagaaagcaagttgagcaagccaggggaagcaagccagtaagtaacacccctccatggcctctgcatcagctcctgcttcctgacctgcttgagttccagtcctgacttcctttggtgatcaacagcagtatggaagtgtaagctgaataaaccccttcctccccaatttgcttcttggttatgatgtttgtgcaggaatagataacctgactaagacagtagccaacgatgatgctgagcctctgattctcctgcctctaccttctgagtactggatttacataagtgagctgtcacaccagtttatatggtgctggaatcaaaccacaaaggctcccagcatgcaaggcaagcattctctcaactgagctacagcctcagttttagcaatgcaaagaagaggaaaaggagggagaagatatatatatttttcattacatatatctcacatatattttacattacaaatatctcacatatattttaaagcgctgtagtggtgagatattgggctttgtagacaccaggcattctgctgtcctggttcttcaggctttatgatcttgaacaccatagttctatttggtgagtctgttttctcaggagttgttgactatgcctttagtccagtgctatctgaagaatgaagatagtatctctctcagtacacctttggcaagggaagataccatctgcccagtatcatcatgtacattggttgagagttaactctgtgctaagtgttgtggtaaatgcattatttcttattccatcctcatggcaatcctaccaaatgtcaaaaattattatccacaatttgtagataagaaaaccaaaactttgacacattaaatgactgtcttaggattttgttgctgggaagagacaccatgaccaaccaaggcaactgttacaaagggtaaacatttaattgtttctctgagcacttctgtcttccaggattctaccacaatggcctttctgctctatttacagtattcaactgtttttttagtacaaagttccaaggtcgtccacagtcctgcaaaaagcaacacaatcaggtacttcccagcaacggcgattcttgagtatcgatttctgtattatttaatcttctgttgctgtgataaaatgccacgactaaggcaatttacagcagtaagagtttatttgggcttacatttgcagagggataagcgtctctcatggtagggagattggaaggcagtgagtggggcctgacagctggaataggaagcagagtgatcacatcctttactgtgaacaggaagcagagacagcaaacagaaaatgggctcaagctaagaaaagaactctcaagtccagccgccagggatgcgcttccttcagcaaagatgctagctctccaacagcatccaccatctggggaaccaagtgttcaaacacacgggtctgtgaggaatatgcttgaccttaacaaagctagggaaatgtgtagactcctctacacagctggaagatgttcactctctcttctttcctttaaacagtttcttaaaaattatataacccactcatattttcctaggtgttacaatcataccttacctttaatcacattttcatttatttgtttgtttgagattttatgtttaattatgtgtgtgtgtgtgtgtgtgtgtgtgtgtgtgtgtgtctgtgactttgtgcacatgaatgtggtgcccatgggagccacaagaaggcatcagatcatttggagctgggaaagcagagccggaggcagggacatctggcagagttcagagtggacatgactagactgagctgggtcatgtggggagatgtgcagaggaagggaaaggggagagatgggaacaaggtgcggcaggcaagagagcaaagatacacacacacacacacacacacacacacacacacacaccacatatgtacatatacacatacacacatgcacgcacgcacacacacacatatttagatgcattgaaatcatttgatatacaaatagaccatgcaaagatcaagtcagtgtgatggacatttccagctgtttaaactttttaatacttgttagtattgagagtcccacccccaccccatttcactgctttacaaagatacaaaacattgttctgggcatgttgggtgcattccttaatcctagtgatgcagaggcaggcagatctcggtaagttgaaggctatcctggtctatacagtgcattccacgctagctagggctaccagtgagattgtttcaaaaaacaaaagtctgtagttatcttcctatattgtttattcttctctgccttcctctttttctgcacacctgtcttctctgacactggtcagcatgtgtgagtgcttgggcccgttaatttgtgtgagcagacatgtgtcaacatcacttagaggaaaggtggcagactcattaacacacacgattaacatgattaggaccagtttgaaagcagcagttctccatcttcctaattcaggcctgactgtgtcaggactctacactctctacactgttttctcagctaacttgtccttcctgtctctcacctcttccccacactgacacacatgtatacacagcccccccaccacatacctaccccccccctacaccacagacttccagagagagggaggtggtgactacgctgtatgtgtttaactgttacctgtctctccttagttctgaatgaaatggaatctaatcttaatcctttcctgtcattattagattcatggagtcctaacggccagagtctctagatcctgtcttatgaaattcaactctcatacaaaattcaaagtatcagtttcagagaaagttatttgaaaaaaaaaactgtggagttgaaagcaattgaggcttattctggtcctcttactcagtgtgtgtgtgtgtgtgtttctgtgtatgaatgcatgtatgcatggggtatacatgcatgtatgcatgtgtgttcatgtttggtgtatgcatgtgtgtatgtgtgaggtatgtgtatgtttgtgaggtgtgtgtattgtgtgcatatgtgagcacatgtgtgtgtgtgtgtgtgtgtgtgtgtgtatgcattcagagacagagtgtgctcagcttccagtagatcctcagctaggaggtggtatcttgtgagactcttccctctgcatgctgaactgttgaccggcttgacctgtgaaggtcttgtgcaggcaaccacagctgctgagagttcatgcatgcaatagtcttcatgtttattgtagttctccctaactctggttcttaccatttttctttctagtctgtgatgttctctggatcttgcaggacaggccataatgcagataccgagttttattgatgtcaatggtccactgggctagcagccttactgactctgggatagatgctgttaaatcaatgacagtggctttttaagttacatccagacgttaggcaggaatagataactcagatataacacgaaggcttacccctgtgtttttgattttaaaaaattgtgagtgtgttatacgcaggcatggttatgcacattgatttgtgtggttgtgggatcttatgtcagagggacttagatgtcttcctttattactaccgatgttattcttttgggacaggaacctggacttcatttctttttgccaggaagtcagaaagccccagggatcctcccatctcttccttcttaatttctgggcttctgtaggcatgagcaaaactatgcctggcttgttaggtcggcactggtatctgaacctttgcttccatggttgtacagcaagtgttcttaactcatgaggtcccgatttttttgttttacttaatgctatgttgtactgtattatattatgttttgctctctctctctctctctctctctctctctctctctctatatatatatatatatatatatatagactggcttgcaccatggagtatgtgtcagtcaggagataccttttggaagacagtgcctttaaaccattgaaccatttttctgcccatcacaaattctttggactaaaaaataagagtttctttttccttaacaggacaaaactttattctctgatatttaaaatataagagaatatttcaaaatttcaaaaaccagtcccttaagttaaatcaagtgcctgctccttcacatctctcttctcttttgatgtaagcacttattgatctaaactcacttcttgaaaactcggagcatctcacaggcttcgctatgttgcctctctacttccatttgcctcaagataatttttaatttctcttttaactatttcattagcctattgattattgaggaccatgtcaaatttcctaggttttgtgcccccctcctcaccggagactttgaaagaatgtatgtgctgcaaatgacaacttagtttcttgaagtttattaatttctttatgcatatgtatattttgcatttattttcactgttttgctcaatgtttgtcattgttctagtttcctttctgttgataaaacactctgaaaagcaactttgaagagaaaaggacttgtttagtttgctcttccaggtcacagtccattactgagagaagtcaaggtaagaactctaggcaggatgcgggagccgtgagggagtgttgtttgctggctgactctctggaatgttcaaactagttttattatatagtttgagcctgctagtctagggatggtgctgcccacagtgggctgggtcctcccacatcaatcaatcatgacattttctatgagacacggccacaggacaatatgatcaaagagatctctcaattgaaaactgaaaaaacttcctcttcaggtgaatctacgttgtgtcaaggtgacaacttgtccagtagtactaagcagggcagtcatctttaatcagagagatgacagtatatattcccttactgtatgggtttgtgttgagacacctataatggcagacagattaagtcttcctgcatctgctcagagcccctgtccaaacagttccttcttccctcttgtctctccttcttcagacagcctacacaattcataagcaggagaaaacatccataggatgttttccagttagtgttctagaatttcagtagtagaaaggatataaaaattacttagaaacagggagtactcaatggcaaagtgcttgcctggcatgcatgaagccttgggtttatcacccccccccccactcttagtccatatttatcatctttcatttaaggaagcttaaaataccagaggactagagagatggcttattggtaaagagcacttgttgctcctgcagaggaccagggtttggtttccagcacccacaaggtggctcacaaccatcagtaactctagtccaggatgtttgacatctttttctggcctctgtgggtactaggcgcacacatagggcatatacatacatgcaggccaaacacaaaagtaaaaataaaaaatattgtctaaaagctatctcagacacagggaagtgcagagatttatcctaaaccacactgttggttaatgtgaaagtcaagctaagataaataaataaataagtaaattaattaattaattaataagtaatagagggttggagagatggctcagctatttagggtgcctgcagctaggatgcatgttttgtttccaggggattgggggcatgagagaaaccttacaacctgctacagggaattggacatgctctcatggcctgtgaggatacttatacacagaagacattctctctctctctctctctctctctctcactctctctctctttctctttctctttctctttctctttctctttctctttctctttctctttctctttctctttctctgagacaaacacacacacacacacacacacacacacacacacacaaataaaaacaaatcttggcttatctgtgcatcctttaatttcatcactaggaaggaagacagatctttacaagttcagggtcagcctgatctacaaatcatgttttagatcaacaaaggttatgttatgagaccctatcctgtctcagagaaacaaaacaaacaataacaaccgctcccccactcttatggtaaaatgaaaagttactaaaggtaggacacccaagagcacacgggacgaggatttctaggcaagcatctttgtgcagtgttgcacctattattgaccagcattgtttcaggaaatgttaggcagaatcaccccgctgttctcggaagcaaaacagaggtgtcacaccttctgattagactggccagcttgcttttcaaatcatctcttctttatcatcaaagagagaaggaaacctcggaacaatgctgtctctgcaatgctatccccactcgatcttatccaaggctgccgtctttgttgccatagccacggagacctgatgcgcaggtatttgatcttgctatgtgccactgaagggtggatattccatcggagaccaaagaacaggaggttgttaagtgtgttgtagggaatcagagccatggagaagttgtttgatctgagtccagggctgagcaggacattggtacatcctggatgaaagctttacggtttgtacacagcttggagaagtttaagtcttggaaaagccgggcagatcccatgtgttaactcctccattgctgccagcctttccaagcctgtttcacttaacaaatatttattgagcgaggtcattacctccaattttcactacggagacttgaaaattaagacacgtactctgcctttgaggacctttgaggcacacagatgtaaactggccattggataatatcatacatgacacgtctgagacacgtgaggggaaagtagaaaagggtctatgtctcatacagcaaatgtataaagttctgtaggtaaagtgccatttgacatggctcctaaaagtccccaaagatagatttatttatttatttatttatttatttgcacatgaataatcaacttgttgaaggactgagagaccacagaaaaacaagcaggaggaatagcgaccatccaggaaagaggcttgactgggcagaagggtcaaactccaggagacagaagacaatttgaattaagattagccaatctcagagattccttatgaatggcttgatgataactcctcagtcttagccagtgggaagttttctaggaggaattctgattgggcagatctttagccacatgcaatgcccgagggtagaagatgtgtcttcttattctgggcagccacactgtcagctgaaaatagggtgtgtgggttgtcatgtggacagtggcagttcctataatccatgcctacctgtgctgtagctgcactccttgacttacacacacacactctctctctgtttctcccttcctcccccctctctccctcccttccctctctccttttgcagaggtgggtattgaacccccgacctcgcacgttatgatagacaggcacgtatccctgggcgctatgctgtactattaacgatttgtatccctttcctctggagaggagatggcgggcttttcaaaagaaagaaagaaatattcttactctatctatagtacccaacagtgtctggtacacctacatacacagatatgcagggcccgtggaaacacaacaattccactcctgtttaggcaacttttcatgctctttttttccctctgaacttggcttcatacagtttttagtgttcaaccttagtcttgttaaatccactccaccatagctcagcctaatcatcggcttttgaatggatttacagaactagacacacatttcctcctacagagcagaccttacgtcccatcagaaagcagttggttacacccaaatgttgtatggccctccattaaaaaagatgagcttatttgttttatgtgtgtgagtgttttgcttgtatgtatacatgtataacttgtgcatgcctgatgtctgttcaggtcaggagcaggtgtttgctggatctcctggaactggagatatagatactatgacctgctatgtgggtgctgggaatcaaatccaagttctctgcaagagcagcaggtgttctttttttaagttaatattttagagaatttcatacacaaatactgttatttacctcattaccaccccactcaacctggatcctacccccaaccactcccttctaaaatttatgacttcttcatttcttttttgagatttatttatttattttatatgcctaggtgcttctatctatgcaccccttacacggctgatgctcaaagaggccagcagagggcgccaggtcccctggaactggagttagagatgacggtggcttttcctccctttttaccaggagacctagtcctcacagaggttttcaggtcagttccagtttgattccttcaagtcctgtgtccaaagtgtgtgttgtctttagccatacgcgtttaatgtcaagttctgggaggcaccaaagagaacagcagaagccgctgggacttctctgaccaacagcacggaggtttttcatacacggtactagatagtttttggctcttgcagggagcattatagcccaagctggtgtaacaccatttaaagcacacgtaagcagtatatgcatatacttacacttgtattcatttatgtattatgcatgtgttctttttagagatctattataggtgtatgaatgttttgcccacatccgtgtacatgcaggacatgtgtatctgatgcctgagagagttagaggagagggcatcaggtcccctggaactggatttacagacagttgtgagcagccacgagagtgatggagactgagcctgtgtcctctacaagagcagttactgcttttaaccactcagcctcgccccgctacgcgtggatttttaagtaaacacgaaataaacttttcctttcgccttttcaaactcactttgtcttatttatgcctcttccctcttttccctctattttattcttccccctcccattaaagccccacccccttttctattcccccctccctttttgctaggacacagcaagtgctcttaactgaggagcagtctctctagaacccccgcccacgccacacatcttttagagctgaaaatttcctacagcttccgaaaggaagaatcaggatagagtttagaaatataaccaacagaggagaagatggcaaaactactgctgccttcagcacagagaggctttacctagaaaatggggggggaaatggaaacatggaaaaatgcattgattggaaatataccgaggacatgggaagttttaagggtgatgagcttgaggcgaggaaaccagatttgtacagttttggaagaaacatgcaaagtttaaattcggctggggatcagaggcagttattttatggcaaagatgagattggttttgtccagcttggcctcatttgtacctctccattttagctatagtcacatcttattaatacttacctcactctttggagcttaggcagaaaatccattatttatggttgagtattcaccatttatgtgtaagtaaggacatctgtatgccattgaatatgtggttgtgaagtaattaaaacagtttacagtgtaaaatgaaagacatttctctattttaaacatgcaatagagaaatggcattttatatattgtttagaaagatttatttatttatttaatgtatgtgggtacacactgtagctgtacagatggttgtgagccttcatctggttgttgggaattgaatttaggacctctgctcgctccagccaaccccatttgctctggttggccccacttgctccatcccaaagatttatctattattataaataagtacactgtagctgtcttcagacacaccagaagagggcgtcagatctcattatggatggttgtgagccaccatgtggttgctgggatttgaacttaggaccttcggatgagcagtcagtgctcttacctgctgagtgctgagtcatctcaccagcattttatattctaactagattcaatagacacttttgttttgttttgttttgtttgttttttgtttgtgatgaagaatactaaggggtttttacttagttagcagtaagcaagatgaactgaatatattgtatcaagaggcatcgagattgcatggctgtaactcaggtggtgatgaaggaggataaccatcccctggaggctaacctgagctacacagcaagacccaacccaaaagcagccagccaaccaaaccaaactcaaacccaaaggcccgtgaaaaattgaattctgatgattagtgccccataaggaccttatggaacatgaaaacaataggaagaacaaagagaacgagcaggtcagaaccacacttacccaaattaaagtctcccagcttggaagatcaaatcatacattacctcaagtaactcatatttgtctgcaaggtgtcagctgaccccttttctttaatatctcacttcccacccccacccccttttaaacagaaagacctttgattgtggtggccaataatttgaagttttgaagaattaattggccctattatacatgaagacatagtaatcccccttcacttttggaagcctcggagagagtttgagaatttcaagttgaaatatcaccccctttcacaaaattctgtatttaaggatagtatttttcagaatttaaaaaaattttttactggaaacttaatattacagcattccccttcagggtttatggtcaagcttttttaaatatatgttttatttctttaactggcagatgtttgaaagatgagagtaggattaatcctcatattaatttttaaatacatctcattcttccaaagaatgccgagaaaaagaaccaactctccatgtagtaactggcaaggaaggaaatagggctcctaccatggcaactccctgtcagggatgcttagtgttgtttctgtccaggttcctcactgctgagaacaaatagccaacaatactgagagacggggaggtttcttctggctaacagtttcagggatacagttattgcaggagaggagaggagaggagaggagaggagaggagaggagaggagaggagaggagaggagaggagaggagaggagaggagaggaggcagctggttaaaccgggtctgcagtcaggaagcaggggagccacacataaatgccgagactacacttgctttttccttttgctccactgtgagaacacagcagacctcaaaacacagcagtttgggaaccaacacacacgtctctttgtgtctggcaattgatgtaagctccatggtttttgctttttttctagctcctttaattgattgattgattgattgattgattgattgatttctgagactggattttgctctgtaagccaggcttgtgtagaactccaattttggctggcctggaattggagaagttcatattctcattatacagagtgcttaatggcaccgttatgctcaggtcattcattcattcattcattcattcatgcatgcatgcatgcatgcatgcatgagataggagttttctgtgtagctcagaatttccctccaacttcaaattctccttcctcagctttcctggcaatgaaaatacaggcctgcgccattatgcgcaagttatattggctgttgttaatatttatgttaggaaaagaaaatagtctctgttttacatacaatctacttggaatcattttttttttttaaagttaagtcggggtgaggggtgtgtgcaggttaacaagcaaacgcaattcctccagctaacgccaaggggcaccctctccttcccctcggtttctggagcgccttgagttctttccatctgcacaaagagcccggcctcctcccgggtgacatcacaaagggtcgttctccgccccttcggcgccaccacgtgtgtccccgagctgagtggccatccgactcagtccctcgccggccggtctaggcagcggaggaggcgagtgcttgatagtggctggaagcttcgctatgggaagtcgctctttagcactgtcgcggctagccctgctctctggttctccgcagccgctgtcgttggagagcaccgggaggcgcgggttgcgagcgcgcctgcttctcaccgcccgggcgccagcgcccctgggcaggtgctgagcgcctttcggagcctcccctgctgcctccctcttccgcctgggtgcctggctgctgcagtgcacatgggctgctggaggtagatgggctcaccgcccgtgaggcggcggtggatgcggcgctgggcagaaacagccaccaattccagctgccgtggggccgagcgccccgggcgccgctgcgagccccgagctcggccatggggacccgggcaagcagcatcaccgccctcgcctcttgcagccgcaccgccggccaagtcggagccacgatggtcgccggctctcttctcctggtgagcgataggaggggaccctagggtggcggctacgttcgagcctgtgtccgggagccgggcgggtcctcgggcccgtagtgccggaggcgcgcggtgggaccagacgggttggaagggttggttacaaggcaatagccagaccgaggaggactcctactagatcgtgtgtgtgtgtgtgtgtgtgtgtgtgtgtgtgtgtgtgtgtgtggtgagctaaggctagtgagtgttaaagaattatttttcttgcaatctggctgcttgaaggaggcgcgagaggtgtccgcctcgaggtcctgcgcatttttgggtttttgcccccgactcggcctatctcgcaccccaacacccagcctcaccccaatatcattcgctgccagaccctcggcgcggtgcgaggcccgagtagtcctgtcagtagccagctgccggttgtggccgctcctttgtcgctactgcaatgtcatgtccggatgctaccgcagtggagacagccggatcggtgcgctccggacgcgagcaaccgctgcatgcttccgcgcgcgaagctttccggagtagggcgcaggccaccccttgcttcagcttccttgcttctctcctccctcttagttcagatgggtcctgatttctgcaagccaaaagaagaagaagaagaaggagcccgggtgggtggtgggggtggggtgggagggggaggaggagaagaaggacccagagacccaggcgcctctaaagcacaggcttggagccaaccggcgctgtggctctcagtcgagggggaggggaaagagctacataaaggacgattaattttccccatccttttcttatttctccctttctgtgtttagacatgtcaccaagcaagatgatgcaggctctctcagcacccaaatctggggcgtgcccggattgcaatcctccatcactttatctgatcaaaacctgacatcatcccttatccaaaacttacccccagctggccctttatttccaatattggggccaagtggggaattaggtggaagaaaatttgaattcaaacccttgagatgctataaaccaatcatgtctttcatccctgcagggaggatgaaggttgttagctaaaaactaaacaaaaacaaaaaagagcttgttttcatggttgggctgtgtaagggaaggcaggcctcttgtctccttcctctaaagggcttactgcctggccagccaagatctactgcttccatcccaaggcatgacagttgctatggcctgggaattcattctacagacattctggttctctctgtctctctctgtctctctctctggctgactctctttctgtgtgtgtgtgtgtgtgtgtgtgtgtgtgtgtgtgtgtgtgtgtgtgtgtgtgtgtgtgtttagggagagagagagagagagagagagagagagagagagagagagagagagagagggctaaagaaagtttgttgttcttagcatttatgaggtaaatctcagtgtcccttgagagacgcttttctgtctttttataacaatggcaaagtccaagccctttaaacaagtgtggatagtaaataatcagagagtctttgggaccgtggacttgaattgacagtcttagattgaacgagttcaaggaagcactgatcctaatgacctgagttaggtcccttgctgagttccctccaaaggtcttagacctgcttccgtgatgagcatatactgccgtgtgtccctgctccacacagatacaatccttatacaatacttatagatcagtccactcaaatccaatctaaagttagtgctcaatgtatagtcgtaatctggaattattttttaacttttagcctgatatataggtccttgaaggtctcagcatagtaaaaccatatgctttaagtaaccaagaaagggcctagttctttttattaaatgatcaaactcaatgtacccacagattgcacccagatttgcaactgatgacctacagtataagtttgacagtttgatgaagtttatgaaaggtattttagagacaatctcaaggtgacgatgctacagggttccttgatttcctggtaactatggcaaaagggctttctttaaattgatggagtaggaggagggtgagctgaccatcctggagtgtgggaatactccaggaaacatcaggagctatgcaatgaccttctccatccccactttggacggtccagtcatcaggacgggccctgtttctgtatacaacagtgatctggtgactctgttctcaggagaattggtcccattggtaatcttggccacattaacagcagacaccaggtaggacagctcaagtaaacatggtgtgaggtacctagaagaataatgggggatacaggaaggttaatgctatgtatatacagggtggttagataaagaaataatgatggcttccaattgcccttctctcatttttttttcatagcagtctttgttgttttttgtggctcttttttttttctatcagcatgaagagcttactataggctctgatatgtatgcctatcatatgaacttgtcaaaagagcagcgagctaatttatacagaatatgccactatccctgtcaaacgggtgtcacctccattctacggatgagaaaatagtctccaagaatcttactggtctgttgtagtatgtggtgactctgggctggaactccttggctcctactctctctcacccacgtaccacactgcccgtttcacaacttcaagttgtttggtgagtgtaaggacagagaaggactgctggcaggtagctgagacggtggcttgattaattggggaatataagtgagacgttcacaaggacctttggagtgagtcagtctagttgctggcatttctattgctgatgtgttgatgtgaccgtgtcatgtttggaagttactcacaaactgaaatgcagcatacacgttccaggccaaagttctgtaaatgagacatttagatctgtagtggtttagggattgtcctagaaggacttgcttactgcaatgctggatgcagtcagaggtgcctcttgcctttagggagcttggtttgactatacagatagactgattgcaagggatggtcaagggaggaaagcaacttccttggtaaagactttggatttggagctttggaaactgctgttatccacggactgagaattcctgcactgaaggcacagggaagaaggcatagcagaagaaggagtggaaagattctaaaagccagaggaacagaagttgctgtgagatcgtgtcacctggaaatgtccgggaagcttcactcatgaagtttcaacagcatggctgcgtaagcgggatctgatcagagaacaccagtggacaggctaacacagaagggggaacttcatagggcctcagccctagacaaaaaattagaaatatgggctactaaggaatatatatgtgtgtgtacaatacgtgcatatatatacaaacatatgcacacacacatatatgtatgtgaatgtaacacatgtgcatatgtattatgcacatgtgcacatatgtaatagcaattgaaaataacgccatgaatttgagtcgtgcaaggctggtacatgagaggttggctgtcgagaggaaagggaaggaagaaaagatttccacacaagaggttgtccagctgtctggccatcccttttctaggcagctggcatctcaccatttctggtcaccaaaagaaaaaataccttatttatttatttatttatttttcttttgccggtgggaaatggtcagacacatcatcagacacatcatcagacacatcatcttgcttagagggtcccaagtgttactgttggccactgctcctgagttctaccttctgacttccaactatcacagaaaatggctatctgcctgggcaggagtgtacatgtgaggtcatctggggtggggtggggcactcaagtcctagccttggtgacaaatccaattagaatatgaaatcagagctggcgggcatacagagggctctctccctttgatatactttaacacagcatcctagactgtggaagctgggagggaagctaagctgttactgatctaacaccccacacagcttggctgagggaaagaacagcctccactgcggaagtgactatttttcattttaccaaatctacatggtgcagaggcgggatcctaagcagtggaagcccagtgatgaagtgggattagaaccttgcgtggcatgaagctcatttctgtggcttataaaacaagtggccggtgtcaatggatcaatgggtgagcatgctagaccccgagagagacacagatgtgatgttcacatcttcaaaatatgtagtctgtcagaggaggaaaacacttctattttggaaaactttccaatcttggaatgatatatgctagttgatttatgggaaattgttaatgaggaggaacaagtaatccagatcttctactggattgaacaactcctgatttttaacccataagttatccccacaaagtttagagtagggtcaagctttctcatttggacttactgtatatctctggctatcagatttagtcacagacagacagacagatagacagatagacagagtctccaggacaactaagcaattaagatgaatctacaagaaaaacctctgtagttacacgggcacaggtccactgactacttatacatctggacaatgtctaccaattagataaagcaaccatagtttgccttccccagtggtcaggggtgggtttggcttcagagctgggtctagtgagtagctggtgtcttctctttggaatttggggacatcacatcttgacttttgcacttgactccatcttgaggagaggcaaagcttcttgggaggcttggtagaaaagctgcaaattggctctgtgctaactcagccagcaggcaaactataattggcttacataaagttcacgattattattattatttttttttcttttggtgacgggaaacggtgagatgcatcatcagactattcaagggccaggacgaattgagcgacttttccttgcgtaaacagctctgcctattttccagaaagcactaatactctgttggcttgcttcccccctgcacaggcctggcaaattgcggtaatgccaggtcaccaccagcaacttcttggcaatctcaggtgcttctcttctgtgactagaagggcccagattaactggtgggtatccggtggtcatttggagttgagtccatttggagcacgagatgcagatatattggatggacagaatgacaactgaagccattagtaggagcagcttggcccactgagtgtcagcaggaggctggacttggttgtttctgcattagaggccactgagttgtgttctttaggaatagaggcgagagatggtggataaacactggctttctccagtgtttatatttgtcaaatacctaaaaatcaacaggatcttaaattggcttgaaggctgccacctggttggacagtgattattaacctggagggagactggcagatgatcagaaatatgggtggggcctctgcttatggagagaggttttgatgaccgtgctgttgacagaaggcagatgcgcaatcaacattcatgaagagtgctgaagtcggggtcgtgtgtgtcctggttggaggcaacatgtctatagtgttaggaaagttgtgctcagggggctctcaggaaggtgtgggatgcagcaggacctcggtaagctggcaggatgctgccccatgtcctttgatcttctcttcagaatggttgcagactatgcatgactcgtcgcaggtctaagacaaataaaaagaattggagagaagcacatagccaaatcagaacacggctagtagagctatgagacaggcctatatcgtgttccattcgctctctgcaaccaggatcactgtagtggctctgttgcttggcaccatttgcaaaatctgcttggagggaagaggaacacaggcttaatagagttagacaagaacatggagcttgtccatgtgccctggcctcaagagagcagctgtgaaatcagcagagctcctgtgttagtggcctttggaggaggactaagcaaatggctgctaaccctttatattgggatgttatttaatttatatattataaaaatattatgtaatatattcattcatatactatagaaatggttcttattactgcattgaatatcttctgtaaagcactacagtgtacattttacaagtcccagacatgacagctttagtcccattttacagaatccagaataaggtttgatagagtttttgctcagatatctgcccattattacgttctggagagagggatgaaatctagctcagcatagtttcaaacacttagctctctctgccaagagagaatggaacaagtgaacagaatggttcacttcaacttcccatacatacgtttgtttattctaaagggaatggttttacccaagaggtgaacatgcccgttttattctctgagtttcacagtggtacctgaatggtttgccaaaactactggtacttgtgagcatggtgtgtgggagctgaaaggggagggcgtggagacattgggcgaacactttcctatggtgtgactctgacgagccatggtgccacggttgagatggaaagacaccccagcaaattgaaactttataaatagggaacgggcgtgttggctctcctgcagccctgggtcactttgaaaaatatttgcttaatgagtaacagcgaggtgtgggctccactctgctgtgtagttagtttctgctcctttagtctgagcacctgaggacctgctagggtctttgctgctagcctgactctttgtataggataatagctgtaccagcaatgactagcatctgtccacatttcattccggttctcattccatggtttgagtggttcgtgctaggaatgtagtggataggttgccacagttactggagcaccctcataaacaagccgttagagaaaaaaggagagagcttcatacatgcataggatacgttttgatcaaatccacagcccttcactctctctctcccctttcaacttctcccaacagccccctctccccatcacctttccctcccaatttcacgtgctctttctctaaatccactaagtccgtgcacctgtaggtacgtgagtgtaggactatctactgccgcatggatagcctgtcaggagccccatccccaaagaaaatggagtcttcctccccgaacagccatcaattcctaacggcttctcagctaggggtaagaatttatgactccatctcctgcccacgcaggcttttgactggcttggttttatacaggtcttgtgcatgcagtcccaaccatgcacacttcatgtgtgcagggccctggcatttctagcaaatactgtttcactctaatcaaatgatccttttggatcttacaagttttctcctcttctttgagatccctgagccttgtgggggaggggctgagatgcatcggtctcattttgcacctaacactccaaggtattctaggtattctattctctgtccgttgaccaggcgtaggtctctctctctctctttttttttttttttgattcccatcttctacactgttggaaggggagggagctatgctgattaaatgagctttgagatctgttgaaatcccaatttgtagccttagcagacaaaagctggaaggaaatgatgtattagtgccagaaaagagattggagttctggtctcccaaaaacctttatgacaagaccactgtctgatttcactgcagacatggctagctagctctgctcagcaaggactcagagaggcagcggggtacgaacgagacaaggaaacttgcaggcaaagatgacaggttttcagaacagtccaacttgtatgtttgtgcttattttggccccacttttctttccataattatttccctttctcctacaggggtatatttgtgtttttcatcaacttactaaagcgtaaagactatctactaaggaacaggcatggctagggtgtgggtctatagaagtgactacaggttatctgtagtctccccttggagttcgcagaaaacgtgatgtttcatggtaatcatcataaagcagaagggagtggatttcagtggaagggaccggtatgtagaatagccccagtgtaggacagagtctgtgtcttcatctctgaccactatgactgggaagaggcagtgggactgtgtgtcgtgggacccttgaaactatgaagattcgttcagtgcaggagaagcagggtaataacatggcttgaaacattctttttttttaaaccttatgtatctccagatctcacatctccagaaagttcctggcagtcttgagacactaatatgggttctgggaaccaaatgcaggcctctggaagaacagcaagtgcttaaccactgagcatcactcccacctgccaacattgaaaaaagaagttttaattaatccttagagaattccatttagtgtattttgattccattgctcctgaagctcctcccagatcctccccaccgcttaacttacccaagtttctctccctctcgcgcctccttgcattgagtatagtttgtgttggctaactgcttttgggtatcaggccacaatcaataaggaaaaaacaaaacaaaacaaacaaacaaacctgtttctcatactgaggatggaacctagggttttcacatattgagcaagtgctctaccactgagctgtactcagctctcagatcgctccagaagcctgctggaggatggaagctggaggtcagctgctttcacagggtggagatcacagtgccggggatagtggcggtgaagatgaattttctagaatttactggtggtaagatgggagggggtcaggtggtctcaaaggaggcggactcctaggtgcctaaattgaagtctgtgattggaaggatgggctgggggcgtggcgggtagaattagaaccctaagcttctgctgtgtagtgagttaagtttgaagtgtcggcgatgaacattggcttgggccttgattttgccattttgaaatagctgactctctgcaggtccgaagcgcactgagccatcgcgactgtcgccaggcatttgggctgccgtccttcctccgcagcatccagcagcacagacatctgtgtgtagagcaatgctctgttcccccttaaggttgcttcctctgattgcattccccaaagtggcattgccaggtcagaggaaacgaatgagtggtttttatggcgttcgctgcagattgccagattgttttttaggaagacaatcaattcagccaccagccacctataaatgtgctttctagtccatgaatctgccgcgacgggactttctcatttcaaattacgtatcttctttttaattcagcgatgtaaggacctttggtggtctctgtgacagtttagtcatttctaggggcataataaacttacttgcatgatgcttgacttttaatgactcatggtccttctagcgagtagaagttatgctaatcttatttttatcaattctacttatcattctggttataggttcttactagctgtaatggcattgctttatattctattgactttttacgatcatgtttacgtatttgctttgtttgtgtgcacgtgggcatctctgtgtcacagtgcatggaggtcagagacaatttatggagtctgtgggtcctggggatagaattctctacctgtcaggcttagtgttaagccccattgcccactgatccattgcaccaatactgcaccactactgtactctactataatatcatgaaaaaaataggattgtgttattaaaccttttcctttctgggtctgagaatattctttttgttttgttttttggatttttttttttttttttttttttttttttttgcccattttgttaggaattcatcctttgacaggtagttataaagaatcctaattgctttgaattttataatgttattggttgacttgttgatatttctggatattggtgtcgtatatgtggtgggaatccccttggtgtgttctgaaggctatatgtgcgtgtgtgtgtgtgtgtgtgtgtgtgtgtgtgtgtgtgtgtaatggattctgtgggtaaacacacaggggagtgctgggcccagctgattcaccatttcaggctgttcttccgtggagtcacctgggacaggtgatagctgatatattaattgtacccgttcaggagaagatatacggagtattttctgaactctagactagggcatcagagactttttctgtaaagtgctgggcagtacggttatcttatgatatctgtggtaactacttaattccacctttgtgcaagacatgtgcagacaatgtctcgaagagtgagtctggctgtgtttcaataacactttatttgtggataatgaaatttgagtttcacacagttttcactggtgctatattgctactcattcattcctcctcatttcccagctgtcagactataaaactgttgtaggcctgcctataggctatacaaaaatagacggcgatagagtccagcctgcttttagaccagggcattaatattgtgtgagagcaaattggggcaactcactttggaaaacccttacttaatcgtgttctgggcatctaaagtgagattattaattgtaaatcctttctattttattattattttttgttataagccaaggtttatttcattttaattaattaacttactttgaggtagtgtctctggttgactaggctgacccaaggctaaccttgaattgcctccgttttaagtgctgggattatggtgtgtgctggtctcggaactcaccaggcaggcgctcaaatagctgagccagccacatccccagaatcccaagtgtttgcttgtttgtttttaatatagtgtgaaaagtagccttgctttctcttgtctttatcttgacgtctgctttaaaacaaaacttctacagtgtgctctgtgttcggggaagtgagtttcaggattataattttttattttttaacagtattattattattattggtatttttgagacagagttgctctgtgtagccctggctgtcctggaactcactttgtagaccaggctggccctaaactcagaaatccgcctgcctctgcctcccaagtgctgggattaaaggcgtgcgccaccacgcctgcataatcttttattaaattaaataaaagaaataaccaatttttggtgtttgaggaagaatatccctatggaaatcagcttgaataggaaatcagtgtctagcacaagctggccttggattttgtgatgttcccgtctttccatcctaaattctgtggtcataagtatggaccaccatgtaaataggcaagtaccactagtacataggcatgcatccagatggcagttcttttcttatttgcttgttctgagccagtttgggtgtggatccctgcctcactttgaatacactatgtatatccatctggccttgaactcactaagtacaccaagctggctttgaactcactgcatacctcaagctggccctgaacttgggatattcctcatgcctttgttcccaaagtgctgggactacagtggatgccactgtgatggagttgggttacacctttaaacaaaaaagtctagagtttggaggctggaaatgtaacctgcctagcacacagacaaccttggacttaattgtagcatgacaaaacaaaacaaaacaaaacaaacaacaacaaaaacaaaacaaacagcaacaacaaaaacaaaacaaaacaaacagcaacaaaacaaaacaaaaaaggaaacatttctcaaatttatacttaaaatagaattgaaatgttttaaaacattgtctattcacaggtaataaacttaaagtctagtaaaataataaattggtggggtgataatttcccaaactggtattccatccagcaattaccatgtcagacatgttctccatactccttctgtgtagctaattatcaaaacaacttagaatggccgttgttattgctgtgtccattttacaagcgaggaggtagaggcttggacgttggctccttcccaggttagaaagatagaaaaaaaaaatgtaattttcttcagcttaggaaccagattcaccagctgacactcacagggtgtcttcaattcacacccgaccctatttgcttcaagatagctaccggttggaaggctagattccacaagacggactctaacggacgtcaggtatcaagagtaaaagtcaggttataacctgtgctttctgttgtctgactgtaagtcagagttcctatggctctcagggggttcagttaacttgtaagcatggcctcacatatctcagggaaacactttctgaatatggctctcttctacagaaaggagacccatgataaagcatgcagaggaaggcatgcttagggcagccatataaggagcaccgtggagctgtggagctactgtgtctgtctgccttggacaccgtgagctctctgaaccttgtcctttcagagttttatggagatgctatttcataggcacaatttactacgtcattagacactggtgactaaacttaaccttcaacccctctcctcatcccagagattgaggtagaactgaaagtagcaagctgaatataaaaaccttgtgtgttctgaccactggtctccatcttggtggcaccctctcagagcctccgtcccctgtcattttatcaccacccagaagaccctaatcacgctggctgtgagcttccctactttgtaggatccatgggaagagaccacatctatattccttattatcacaggatcgcggccagcagatacctgggcgagcagggcgtatgtggtacattctaggcttaaatggtttttccttatactttgaagcctcagttgctgcactggcctgggttgtatgctcttccagacatgcccagtcagcatgaagttgcatccttccatcatctactgttttctatgacatactatttcacttattactcactgggcatcctattggcatctctcagtaagcagagaataaagaaattactactgtgttggagggagacggggctgtggtccagtgactgattgctgtatgcactttctcttctgcattgcgggttccagagaaaacagctcctaggtgaaatcttccctgtttttttcctctccagtgtcccctgagcttgcctccttctgttcctacagtcagcacattctggctctggcattctctatagtcaccagcttgaaaaacagtccctgcttcctttgctttggcaataggagacggctctccctccttcccattcctctcatccctcccatcctcctcttccttcatctctccctctcttccatccttcctttcttccttcctctttccttcttttcagagaaggcagtagaaatgaaagagccaaccaagtttatataacataactggaaataccctgtctgtgatttgtggaacctttgtccttgaaacgtttgtttgtatgtatcccacctgccccacaacttcagatctggggaattatagccatccagtgtttatattacaaattaaaaatgatggcccagctatctggtcaacaattctgagggctgagcagctctgtctttgtcatcaggtatcatatttcatagtcatcctcataggcaaacctgattaccttacaatctctacagtaactacacacacacacacacacacacacacacacacacacacacacatatatgtatatacacacacacatacatgtgtgtgtgtgtgtgtgtgtgtatggaaaaattctatatcaaagtccagagcaattttcctgcttcttactaaggaaaagcaggtccacctctgtcttaagtttgctcgttttataatgaaatgttactagaacttgagaggaaatgaaagtaatgtctgcctggtgcagggacgatggctcagtgggtaagatgctggcttacaaatgtgaagagatttgagtttgaatccttagcactcatgtaaaaaggctggatgtggtcttgtgagcacctgtaaccccagcattatggaggctggagacaaggaggcttgctggagcttgctggctgccagtcttgttaaaatggcaagctccaggtttgatgagagagccctgtctcaagtcaacgaagtggagagcgatggagtaggacactctacatcctcctccggcttccccgtgggcatgtgcacctgtacacacacatgcatataccacacacacacacacacacacacacacacacacacacacacacacacacgctaacgtcaatggcacagatctgttgtaacctttaagctaccaagggatctcttgtttatctgaaggatgaggtaatggaagtggaattgctgaacaataagtagatgtctacattctgacatggattcacacatccgggtgcttcttgtcttcagtcaggcccacctgtgctgtaaactgcaagtgacacatcataggtgtgctataggccaccaggatgcacagtgagactctggaagccttcacagtcagtcacctgcaccaagtgctgctctccacttgatctctgcttctctcgtttaagcttctaatcattcaataaacacttgtagtgtttttggttgttgttgtttttaaccaaatacagtttgagacagcatgctgatacttgatgcatctatccactgttgtagttgacattcctttttttttttgattagatgttttctttatttagatttcaaatgctatccctaaagttccctataccctccctccgccctgtaggtgacattcttagatacatggaattttcataataatcgcagtttaaacacagagagaatctaaccttcttatattgcttataatcttaagcacaaagtgtaatcttctctttttttctttcttttaaatgagagaagaatatttgaactctttagtatattagctttttattttgagtatcacgaagaagctaattcttagaagccaattatagttctgttaagagagagtaatggggggctggagagaaggctcagaggttaagagcacaggctggccaggcatggtggcgcacgcctttaatcccaggacttgggaggcagaggcaggtggatctctgagttcgaggccagcctggtctacagagtgagttccaggacagccagggctacacagagaaaccctgttctgcattatagattccagggaagacacacagagtataagtgtgtaagtaagaaaacgatgacaaccatatagggaaaagaagaaaccgaggagggctttacaattggggatgggaggcagggagagcacccaggaggaagtcttgtctctctggatgattttgctttttctcagacgtcagggggaagtgagagtttgaagccgagtgtgaaggaaccagattgagcgtgtgagttagagtgggtggagagagagagagagagagagagaaagagagagagagagagagagagagagagcgagcactctgctcataaagaaacttatgggggagaccaggaagtttctatgagcagctggtctctgcaatgtttgtatttctttagatgcccatgctgggagctggcagatttcacctataaagggccaagtgataacagtaagctaactgaggtttctgggcagaatggtctctgtcatagctttgtcgctttcccacagtagcctgaaagcagccacgagtgctagctacatcagtgtctggactctaggaagcttgtttataagacgagctggtatgttggcattcctttgctggcccctggcttgaaggatggtttgcttattattttcctagtgttcattaggtagttgagcaagtgaggaagtatagtctgtacagtagtccctggccttgagctgcttataagcattaaggaaagataagtatatacacttacggtactgccaaccaacattaagagacactatgtaattagacgctggtacaatagacagaaacaggaagtgcgatgggctagttgctcatctgcttggcatctgggtgtttagaaagagatttaaaggctacataaggatggcaggatttgacagaatcacaacacgcaggagggtagaattggttgaatattactactgagttcaacctgctcatttcctaagtgagcaacccaggatcctgttgacttcccaacaggttgggtaagaacatgccttctcttttcaaaatctttgtccagttcttttcctgactttttctgcttgatccacccagggatgtttatgtacgtatgtttgtgtatatgttttatattgttaggggtgagagaatggggtcgctccaggttatcgattgcatttaggatgtcaaaagactgggaccagggtgatcgtgtctgctacttggactgatgtggagagaagagaagctaggtgaggggtatgggagggaagaagcagttgtgcacaatagaaaactataccctgacctatatacatgcaagaaagcagtcaatgaagtcttggtgggaagaccctctgaagtaagacatacccatcctgttggttgcgtgcctagcctttaatggctaagccagctctgtagaatatgctcattctgttgaagaactctgaattgttagagtgagacagtttgtatgttaaaacagacaggtcttggtgatgtaacagaagttagtaaaagagaaatcacagagcaacatggttggctttttttccctttgcatacacaaaaccaactcaaacaagagaacggggaagctgagaatctgtagttccaaattgctaggactattacatagatgtttattgagggggggtggaagtaaaatgctaatatcaagttatttaaaaatgccaggttaggtagagaagggggtgactctgactgtgagattgggttgtatccaaaatgtggctcaggatcaaagaattttacagtcagaggggtcttggtttagtgttagggactcaagagttagttagataccagaaacactcagattgattaaaaaggcaagaaaaaaaaaacctcacagccaaacaaaataagttcctcaccctgttgtatactcacaacgatctcagagataagacgaggtacatgaagaaagtactttcaaaaatcatctcagacagtattattttttctttttccattttcatgtgtgtgtgtgtgtgtttgcgtgtgtctgggctctcatgtgtggttccatgtgcacatggagccccaaggttgacattgggagccattctcaattgctcttccttcctatttggcgaggcaggtgcttaagccaaacccagagctcagtgatatgtgtcatctctctagcctgtttcttctagggatccgctgacacctctgtgatggaattacaggtagactgatgtatccacttgatacacactcttcccgggcaatttcagttttatactcaaaagccggaaactatgttagatctctctgacctgtcttagccatgtctatacacatggtgggggttgggagaggaatcaagggtcttaattggaaggacccagcctcggttttcttgactctcactatccatgaccttgtctcccctttcccatttgtttgtcttctcctctagggttagctttcactataatctttttatattgtgcaggggccatctttaaatattgtcttccatttggtctatttctgcccagatccatggggttagagggaagagctaatgtgtgaggtgcacatatgtgcatgtgtggatgtgcgtgcgtgcgtgcgtatatgtgtgtgaactatgtatgtatgtatgtatgtatgtagaggcatgttctcaggtagctcaagtgactctcaaacttgacgtgtagccaaagatagccttgaactcctgatcctcctacctcagcttctcaagtgttgggtttacaaacttgcgccatcacaaggggatattgttttgttttgggacaaagtttctttatgtagctcagactggtctggatcctgtgatcctcttgtctgagtctccctagtaccggcaagtacttccacaacttggaaggggaaactcttgtttagatacagtttttccttcttcttctttaaatagcacagtgggattagctattgactctggaattgggagagactttagaggaccctgtagtcttgtttgagtaataagctctgctctcaacaggccttccctctgattaggctttgcaaagcagagctgctctgtttgagacagaagtgagggggcttggagcctacctcccattgctccttggcaagaggcagccctgtgatttttgtccagttcagcgcttgcttcttgtcccactggtttcttcctccatccacttcgctaaacacagttaattcacactctcctttattctgtttgcaggagatagatgaggtaattttataggtcagcattatagtcccttaaaaactgataaaggagccaggcatggttgtgcaaactagcccagctccgtggctcatacctgtaatcccagcagcaactggagagtctgagtcaggatttccacgaggccagcctgggttataaaataagactctatctcaaaacaaaatatcttcaaaataattttacccccacgaaatcaagaatcccaaatggagcaagcatggtatagagtgtagggaatgtgcagttgctgggtggggtttgaacacagctaagtgaccccaacaagtcagacatcaggaaagaacctaccatccctgtcttagaacaaaagtctggacccttgtctagtctggtgggtgttgtcagcaatgtgcacactcagggtggctccctggatcaggagccctgggtggggaaggctggggttgaggctccatttcctagagctttgtgtatctccccagggtgcacacttttgagtctacagtgggggtggggcactaatcttgtactcgggctccattggacagatggtttcctccaccctgggcatctgctgaactccggatagggtgtctgggctggttgtgcaagtagagggagcaggaaaaggaagggccaagccaaacgctgagagaggagacttaccaccaagtagcaggatcttctctttctcaatttccaatatgaaattaaatttcccaacaagaaaaccaaccactatccatcgccaaccacctctgcccctactttcagactcagaaggaagaaaactaagtatatcgtaaactctaaggaggaaacctcaagaaccggtgagaggcggggaagtaccctggccccacataactgtggggttgggaaaagaatagactggggtcaagtttcgagatgctaagaagacagactcttgatcaccttgcaagcagttttttttctttttcttttgctttgttctttcagttaccgatgtagctgtaaatctgtaaatctagaaggaatttgttcggtagctggtagcttggggcagccatgattttcatacaaatttctccatctcactgaggatggcaaagactatcagggccttcattttgacagccccagggaagcagtcactctagtcttttgctccctgcttctctttcacagcatctcaggacttggaacttgggatacccccaggtgtgtgtgtgtgtgtgtgtgtgtgtgtgtgtgtgtgtgtgtgtgtgtgtgtggtttgtccagacagggtgtctccatgtagccctggctatcttagaactcaattggtagaccagactagctccaaactcagagatccgcctgcttctgcctcccaagtgctgggattaaaggcatatgctaccacacccaacgggtcctccaagtttttaatctggaagttggtgaaactctgacctgctgggtgaagtttttattttagaacatgaacactgagttattcttgctggacccaagctcaatgggtagatttctcaatggatgcctgcagggattgtgtctatcggttgtggccttcagagactggacaaactgcgtttgaatctaaaagcaccagctccattgtttaatgcacataacaggactgtcaaaagtatggctgtttgttaaaacaaaacaaaacaaaacaaaacaaaacaaaagtttatcatcaggtatgcaggtgctatagaaatgacaactttggcacacacctccctctttctgatgtcaagttggtgtggtacccgccagatcttgaacagtggtgatgacctgttattgctgttgctgttgctgttgctctgttcgcctctgctcctctatctgacacctctcttatttctttcagcttggattcctcagcaccatcacagct

SEQ ID NO: 2 - DNA, 3521 bp, Artificial
  Synthetic
tggtacattctggtgccaagtgtggccattcccctggctatcgccttcctcttcttcttcatctgtgtgtgccgcaataaccagaagtcttcatcaggtaccgatttaaatgatccagtggtcctgcagaggagagattgggagaatcccggtgtgacacagctgaacagactagccgcccaccctccctttgcttcttggagaaacagtgaggaagctaggacagacagaccaagccagcaactcagatctttgaacggggagtggagatttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatctaagctctagataagtaatgatcataatcagccatatcacatctgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcccccggctagagtttaaacactagaactagtggatcccccgggctcgataactataacggtcctaaggtagcga

SEQ ID NO: 3 - DNA, 2654 bp, Artificial
  Synthetic
ataacttcgtataatgtatgctatacgaagttatatgcatggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgtgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcccctagataacttcgtataatgtatgctatacgaagttatgctagc

SEQ ID NO: 4 - DNA, 106315 bp, Artificial
  Synthetic
cacaggggcactgcattctgggaatcaacctactggcggggtgatttcatttcgtttctgacttttgtgttttggtgtgtatgtatgtgtttaacagagtgtatggccggtgagtttgggttctttctttctttctttctttctttctttctttctttctttctttctttctttctttctttctttcttccttcctgaaagtgaatgtataaagcctttacaatgtataactgttggaaaatgcccaccactaaatttttttttaagttccacatattctccatttttgccttcttatatatatcttcaacactattctgtgcactttaaaaacttaacataaacgcagtgtgacttctcccatatgctgggtcccgagactctcaacttcttaaaaacctaatggcatcttgtgactcctagaagtagacataagtctttcaaccttcacacctactctttctgttttaattattattgctatttgtcttattgtttgtgctttacaagcgttcttgaggacggagggaatctacgaccctgttgatgactgtaactctattcgactttgagttgtcttcttcatgtcttgttatatagttcatattcatggctgaaacttgaccatactccctagcgctgattgtatggttttcgtctggacaccgtacactgcctgataacttgtgcacctcttaacgctactatgctctgggctggagaatgaaatctttaagtcaccaggacttgctgtttcagtggcttgacacctgggccaccaaagaactcgatcttcatcttttagggacacctctgctgcaccttggaaagccaaccttaagtgccagtggcactttatgcccagctttgctttgaaagatatctttcttgttttttttatccttctctttctctcttttttttaaaaatacacatagtcaataggtccagtctgccctcaaggccttgctgggttttcttcatcatccaatcactttcattaaaaatggctgcagctgtaagaactcttgtctgataaattttcaactatgctctcatttatctacctgccctctgatgctcagtcgtcagactctaatgcaaaggtggacgtcggctgcctttgcgtgggcgggcttagtggtgaggaactgatatcagaaaaaaaatgccttcaagtatactaatttattaataaatattaggtgtttgttacttgtgtggttttggtatatttactactgaactttcgcctttccctctgctcaggttctagccctgttcatctcttggggaaggatgtgtgttctgaaacccttctcctgtccaatctgtaaatcatgaatattattagcaaaagtcccttttggagaggtacttggaggttcactgcacagggctctgataagcactgccaagcctttcctagtctttcggagttaaaccttaggtaacttgatacctgtaggacgatctgcacacattcacaggcttctagccaaaacctcactgtccctgacgaactccagagggcttggtcagcagtgaggcggatgtggtcctgtgttggtgggatatctcaagctcactgcaggttttcctaagcttggaccccacctctgcggaattccaatgatcaaacgctagcaactttaacatcctctttttgtgagaacctggaagctgatactgtgtatactgtgaccccccacgtcaacaactgggactgtcttccggtttcactcatctctgtgtggcagctttcaagatgaacatccttgtttcccttccctcttgttggtgcatgcctttagtccattggaagagagaggcaggaggatctttgattttgaagctagcctgggagtttcaggacagcctggctacgctaactaaaaaaaaaaaaaaaaaaaaaaaaaaagatcacacatgcgcacacacgaacacacacatacagagcaacaagaacaaacaagaatgggtcagttatgatgggggaggaaacaggttttgtcaggttctcactgtgtcagaagatttagaactgagacatacaatccattcattaattactagtatgttaagtttatagtttattagtaatttgggaattttttattaataacccaaatttgtggttttatattttacaacatataaagtttaattactttattggatctttaaatttgtcttaacgggttcctattattatgcccattttacagatgaaattgggcttgtaaagctaagtatatgagatggtttcttatcactagaacagagtccctgaaaaggaagaaaagaaattctttaagggaggaaacgttgatcttaactcatggtttccaaggctttaagtccatggttggctggctctgttgcctttggttgatggtaaagcagaaacctggtaagaaaacacgacggtggaaggttgcttacctcctttcggccagcaagcagagagacacaggaagagtcttgggacaggataactcttcagtggcacaggtccagtgaccttctactagctagaaccccctccctaccttatagtctattcagctatgaacacatccatggtcgaatataccactagctgaagcccaaacctccaatagatgagcctttgtgggggacacttaatatccgaagcataaaaccaaggaatgtgtttaagccctcactgagaaggttagcaaggctaggtttgaatccgtgttgtgtatgttttgggaagaagggtagagcgagtggctgtaatctaagactgttcattctctttataagatcactgaccagaaacctgttgccacctgaaacagtgggcagaaacatggcagtgaaatctgtctgggtcatgagtaaagttcaaatgcaagttaagtaagtggtacaaacgtaggcatgagaactaaacattagcattatatggtgatcccatgatgcatagctttcccagaaggcaatgcaccatcagctactttcttaaagtacccagagtcaagtgtgatggatggcacacacctggaacccagcactcacttgcaggctggaagaccaaggccttagggtcagcctggggagagggctcagtcagtaaaccatttgccacacaagcctgagaacctttggatacctggcacagcaaagtacagggctctgtggtgcacacctacagtctccgtgttgggcagacagagacaggaagatccctggggcttgctggctggccagtctagctgaactggcaagcaccaggctcaggcaagtcactccatctcaaaaaaataaggtgtaaaatggtggaagaaggcatccaatgtccaactgcagcctctgcatatgtatgcacaaggtcatacacacacaaacacagaggaggaggaggacgaggaggaagagaaggaagaggagggattcaacgttagcctgggctacatagtaagaccctgtctcaaaacagccatatagctattggagttatagttcattgacatttgatcaacaacactgcagaaactgggtgtgacattgcatatctcccaattctttcactccagaggtgaaggcaggaaagataaaaagttcaaaatcatctttgggtgtatagcaagttggagaccagcctgggacacattagatgctgtaaaaaaaaacaaaccaaacaactgaaataaaacaaaaattcagcataaaatactaaaatatgtgactttctgattaaagctaatgatagcaccatttgtaccatagaaaggtcttctctggcttgcgcttcttcctctgaggagtatagacagctgaaaaggaaggctgctagtgtgagggcagaggagacaagagagcaaccagaagaataagaaacagaagcaactgttgggagatccaagccatgttatgcaggcaggcaggagaaggagtctgttcaccaatttgaaggactaagaaggagtttgtgacccctgggaaaagactacagactcgatccaattataatgaaaagatttgttgattagctgctagctggatgagtaatctctgagccaacttcgagattacttcgcagaagggttacggggaaggactttaaaaggagaatatcacacaaagaccttcaatatctaggcaagcaagtaacaactgttctattttgacaaattaagtgattgaggcgactcaaaacaatcttgggttatctgtgcaacaagttacagaggcaaaaaaaaaaagttagtcataacaagtgttatgtatggggaggaaggtgtgactgagtcagggttattggaaatttatcttccggggaatggagttagagactagtgggtatggaaatgaatgcctagcataaaacggagcttctttcattttcttcagagagtaatatagttcctgtgggctgttttaggctgaactcaattagatagggctgcttttcaaggagaaactgcttcaaggagaggaaggagctgggcgagcatctgtggttctccaactttcatgtaaataagtcacccgggagtgagcagcttgttctctttaaaaaaggctgattcccacaatctgattggagaggtttgtggtgaaattcaaaaatgaagcccttgcaggtttttggaccacacttagaaaactatctttagagaatttccgttcctgccaatggggacaagaacagctaagaggagctggttagactcgcaccttcagaggcctcctgtctacccttttaatgtgcaaatgagatacctgaaggtcctgctcacaggcagactctccaggcctcttctgggaaagggcagctggcatcctgtgttgctgccaagctcttgggtaatacaggcactgctgggtttttctttttccccgtgaaactgggtagtctgggatgactttacctttcaggaaaggggcagaacaaacacaggagtcgatcactcatttcacaggagggaaggaaacacactttgatgagctgaagaaacacccagaaccaagcaaatctggtcaaaacttacaactggttggggctgggcttggtaaaagtgcctgcagcagaagcacggggacaggagttcggatcctcagcatccatgttagaaaataaggtaggtgcagtgctgcatgccccatgcatgctcccagtgctggggaggcagggacagcagaatcccaggggtttgttggcttgctagctccagggtccatgagagtctgtgcctaaatgataataaggtagaaaggtgatcaagaaagacatagaactttgggcacacaaagcctacccctcctccagcaggattgtataacagcagcagaaagaaaggagacttacagaaagaaaggagactcctcgaagcccaactatttggcatttgtgcagagagctctagggatgtagctttcaagggtggacttcttcacgagcagttgtatttgggttactcatacttctgtaagtaactgcaagaaattcatctggacgcaagaagcatcatttctttgttccgttggcagtgccctatctgaggcaaatagacatttgctgtgtctctccaggaaaagtcacacaatacacagtgaggctgcctggcagaggaatcctgtttatcttgtggtcaaccagaataaaagagacaagaaaggccagagtctcagtataccctagaagaatatttccccaggtaatcaacttccctccattaggctgcacctcttaaagtgtctgctacttctaaatagtaaactggtcacaaagattagacacatgtcctttgggactcacttctgaactgtacccctgggctatgaattggtcactttcctgctgttatgacaaaatatcaccactcaagacaatctaaggaaaaagaatttgagcttccacttttggtgagagagtccataaagacagggaagagatggcagctggaacaggaagctaagcctcaatcaagaagctgagaaagtgagctgggagtagtgaggctatataacatttcaaagtgatctgcctcctccagcaaggttgtacctcctcatcaaacagtactacctacttggtcccatcttggttgcttttctactgctgtgaagatcatgaccaaggcagcttataaaaaaggaagcatttaattgatcaatttataaacactttataggggactggaaaggtggcttagtggttaagagtactggctgttcctcttctagaggttctgagttcaattcccagcaccccatggcagctcacaaccatgtataatgggatctgataacttcttttggcctgaaggcattcatgaagacagagccctcatatacattaaataaattttatgaacagcttataaaaacgttataaaacataatttcagagttaccctatgactactatggcaggaagcatggtggtggcaggcaggcatagccatggagcagtagctgagtgcttacatcatgcctgaaagatgttgacagagtgagacagggcttttaaaaacaaaaaccacgttccctgttatgcacctcctacaacagggccacacctcctaatccttccccaaacagttccaccaattagagatcaagaattcaaacatgcaaatcatgctcattcaaaccaccacagagcctacaaggctctcattcaaagcaccacaagacagcaagacctatatgaatcagacctgaggtgatggctgtagcttcctgagaaagggtttggggaatctttccaaggagccagctttgctctgtcccttacaagtagctgtctccccagctctctaggatcttcctagagattagattaggatttctcccaaacaaacacaaaaaaagtccaaatggagagggttcaaactcaacatttaaaaaaagtgagtcacagtaattatgttggggctcaaatatctatttcttaggatagaaatctctcatatttaaggtctttgggaggagaaacatgaaaaatttctggagttgtcatgcatacacacatacacatacacactatatatatatatgtgtgtgtgtgtatacacatatatacacacacatatatgtatatacacacatatgtctatatgtatatatacatacatatatacacacacatatatgtatatacacacatatgtctatatgtatatatacatacatatatacacacacatatatgtatatacacacatatctatatgtatatatacatatatacacatataatatttaaatatgttttatatatttatatattatacataaatatgcttaagtattatctatttaaatatatatttaatatttaaaacatatattataccacacgcagtcctctaaccctccattggagatgtgcctgttccgtgttagttagcattctcctactcagtcaccctctgcttcatccactgcataatgtcaaatgggagatctcacagagaaagaacatgggacagcaagttcattttcaagatcacatgacagttatttccataagtatagacacgtggatttcacatctcgtttcgtccatttgtttgaatgcagcatacctgtaggacggtgaaaggcagcctggttcctggttgagctaaggctagaaaccctactgaccctaaagggatgcttggagtttgcctggttcttaggtaccaggcttcatgcacgaggccacagccctccatagatttgtggccgtcagtaacgtaagggcaacaccgcaagccaaagcccccccccccacctgccacacacacacaggtagaggacgtgacccatggtcacctagcctcaagacacatctctattttaatgaggtacctaaaggcctggaggacttagccaataaactctccttcccagatgttccttcctgcaaaaaaggtatttaacttcaggccctccctgagaagtggggtacggttttactcagccacctttcaccattacaataaatgccttaaaatcatggattgctacttttcaccgggatctgctatggagaagaccttctttgcctacagagctaccatctaatttcttgtagaagacctctctgctctcccagccatggctgccaccaagctcaagcttgctgccacagacagccagagctcctcttttttccccctcagccctgggctagattcagcccgctggcccccactctgttctcaggtcttttgtggctctcagtatgcctgggtgtccaagagcccgagaaccagacagctagggcctccttgtaggccgggggacccccaagccagttctggctgtcctgggatctcagactgtgctttcccattctggaagggttattccatggctccccatagaccaacaccagcccggtgacagtgtggggtaagctctgtcaaaactccagcgttctgtctccccaagtagctgtgctctgtggtgggcacccctacacacacccatccacagaaacacagatgagttcttccacttagtctgagacatctgaacagctactaggttctgggctaggggctagacgtggggagaatttgatggagcgttgaaactgctgatgaggaaagagaagctctctgttcacggctctgtcctggacatccagagcaaagtatagaaatgtacttatgctataggctgaataactgagtgaatgcaagctcctgactgcaagaagttcccaacatagcaagagacacgaagagagacattcttataacaatggtaagtgatgagaaatatggaaacagtaattaattatatccaagcataatggttacattccatagaagcatttgaagacccagacaccaaatacaactcaaagaaaagtgatataaaattttctagtgtaagcctagtaatttcaatgataagttgcatcaaaagtcaggaactgatcaatgcgattctatcctcttcagagctttgaccacgataagaaatagcttgatgccagcttaacattagactctaaagcagtgaccttcctagtgctgtgaccctttaaaacagttcctcgtgttaggctgacccccagccataaaattacttcgctgctaattcataactgtagttttgctactgttataaatcataaggtaaatattgatatgcaaccctccagaggggtcgtgacccccacgggttgagaaccagtgctctaaagtgaactgcaggtgtgctgtgggctctaccacataaacaaggatgccatagcttttctactgttgttgttccccgtttccaggcttatcattaaccatcatcaggagatacgaggcccaggcatgtgacagcttagcagaagacaggccaagtgcaaccttgtgtggagctcattctctgagcaaatgttcaaaggctctgggggtgctcattgctcagtctcactttgaagcctgtactataggaacaggcattatttccactctgttgataaggaatctgagacatgcattgtgatggccccagtattatacagctagcaaagggtggagggagccaggaaggacatttgtagagctgagtgactcaaggtcataaaatggcaagtggcaagtggcaagtgaggtgacttgactcatacctgcctggaaccttttgtcttgactcaaccaaactcctccttattgattttttaaaaaaggtatctttttaaaaaatgtatgtgcatgttgcactggctggttctgtgtggcttgagttatcatagagaaagatgcctcccttgaagaaatgcctccatgagatccagctgtaaggcattttctcaattagtgattaagggtgggagggcccactgtgggtggtgccatccctgggctggtagtcctggattctattagaaagaaaggcaggggagcaagccagtaagcagcacccttccatggcatcagctcctgcttcctgacctgcttgagttccagtcctgacttcttttgctgatgaacagtaatgtggacatggaagctgaataaaccctttcctccccaacttgcttgttggtcctgatgtttgtgcaggaatagaaaccctgactaagacaaacgtgtctgtacccgcatgtgtttatgcttaccatgtgcttgcaggagcccatagagaacagaagagagcttctcaagcgatcctcggaaactatgagctgtctgtgggtgctgaaaactgaacccccatcttccataagagcaataagcattcttaactaccagacaatgcctccagccctttcttttttttttttattacgtattttcctcaattacatttccaatgctatcccaaaagtcccccattcccctacccacccatttccactttttggccctggcgttcccctgtactggggcatataaagtttgcgtgtccaatgggcctctctttccagtgatggccgactaggacatcttttgatacatatgcagctagagtcaagaactccggggtactggttagtccataatgttgttgcacctacagggttgcagatctctttagctccttggatactttctctagctcctccattgggggccctgtgatccatccaatagctgactgtgagcatccacttatgtgtttgctaggccccggcatagtctcacaagagacagctataacagggtcctttccgcaaacgcttgctagtgtatgcaatggtgtcatcgtttggaggctaattatgggatggatccctggatatggcagtctctagatggccgatccttttgtcttagctccaaactttgtctctgtaactccttccatgggtgattgtttccaattctaagaagggacaaagtgtccacactttggtctttgttcttcttcagtttcatgtgttttgcaaattgtatcttatatctcaggtatactaagtttctgggctaatatccacttatcagtgagtacatatcatttgagttcttttgtgattgtgttacctcactcaggatgatgccctccaggtccaaccatttgcctaggaatttcataaattcattccttttaatagctgagtagtactccattgtgtaaatgtaccacattttttgtatccattcctctgttgagggacatctgggttctttccagcctccagccctttcttaatcactggactatctctccaatccttccttattgacatatgtttaaaatgtaaagtatttttgttatgtgtgtatgcaaatgaatgtgctacaaaaaggatgtggacaacattgaagaattggttctttacccacccaaggatcaatcccaggctgtcattgactgggcttgctggccacttagtaaaaaaaaatattacatttggtaggaaggctggctatcctcggtctaatgaacttcctgacccaaccatcccagtgatatattatagacatacatcaccatgtctgacattgatagttggattattttttttaattttgaaataagttataacacattaagtttaacaatactataacgttcacattttcttttccaccagtttcccccaagtaagttagccttagacataatcaaaaccaggagattgacattattatattaccaagcaaagacggatgctaggtggttcacgctggtttcttgcacacacttttctgatgtattttaaacatcagatgtactgattcctgtacccaccactaccatctggaaatagcactacgaaatgtccctaaggacactcttgttcacaattgtaccttccctttcaccaccagacatggcaactcttccacacagttgtcacttacagagtcttacatcaatgaaatctggggtgaatgtgccatccaaagaaacacaggaaccagagttgggttccaggaacccatgagaaaaagcttgggtagtagcatacactggtagttccagccctgggaagacagaaacggtgaaccactgagatttgtagcaagccaacgctaccttttctcacatttagccctacttggtgagcccaggccaatgagagaatctgtctcaagaagcaaggtgcgcgacatgtgaggaagaatactcaaggtctcctctggtctccacatacacacatgtacatacttatgtacacccacacataaatttgctcctccctttggacacatgtccaggagtgtttagaaactggatcacataccatgtaacctccagagactggcttttttctcattgatgtgaatgtagcatagtttaggcatcctcacgctgaagggcttttggatcatttttaattgaagctatttacaaataacactgcaatgaccacttaagaacagtatcgacatggatttttatttctttgacaaatatccaggagcaggatcgctgggagtattagttacttttataacacaccgcaacaaaatcagcttttgggagggtttatatggggcttataaaggaatgagtccagcaccatcatggtggggaagcatgtctggaggcaggaatggtggctaaacagcagctgagagctcatgtcttgaacaataaacaagaagcagagaggctaaatttgaaatggcacaaatcttgaggtcttaaagcccatccctagtgatgtattcctccagcaaggtcacacctactaagcctccccatacacccatcagttagggaccaagtatttaactgcccagaccatgggggatatctcattcaaaccactacactggataaaggtaagcttaatttaaatgagaaatgcccccgacaggctcaggcattgcacacttggtctccaattgtgggcactatttggggaggtttgggaggtatggtcggtcctgccataggaagtatgtcactgggggagggcttcgagaatatataaccccgctccacttaccatttgctccctctctactgcttgtttgtggttggagatgcagtcagtctcttggttccctgctcctgccaccatgcctgtcccttgcagacggactcttctccttccagacccaaaagctaaaaataaactcttaattccataagttgttcttgtcatgatattttgtcacaacaacaggacaattacacccctctctccccaaggttatataaatagtaaggacctctgtggagacaggattatttccagtctgttgtgttgtctgcaaatcatgtagagagctcttgggatacacccttcatgagtcatcacctatactcagggtttttgagtaatgcagtattgtacttgtattgtccagtgttcctgtcagtaagttctcacccataattctgtaagtaatccagataaacacattggcttttgaatggacactttggtaggatagtttctttagtctgtcattggtgctttatctgggctgagtagatgtttgcatgaagtctacactctttgttttttgtttgtttgtttgtttgtttcaagacaaggtttctatgtatagccctggctgttctggaactcactttatagaccaggctggcctcgaactcagaaatccacttgcctctgcctcccgagtgttgggattaaaggtgtacgaacaccacgcctggctgaagtctacactcttataaaaaaaatagtcctgttctcacttcatttctgttgctgtgataaaacaccttggccaaacagaacttggggaagggaaggggttcattatggcttacagttccaggttctggacagtcgatgagaaggcaagcttagtcacctcacacgcatagtaaaggacagagaaaaatgaatggatgcctgctgcctgctgcctgcttgctgactgcctgcttctgtttatcccctgccataaaatagttgagaaccttctgcatagagaatgttgctgcccacactgggctgggtcctcctacatcaatcaacaatcaagacagtctcccacagacatactcacaggatctaggcaatttctcaaccgagactctcttctcaggtgattctgggttgtgacaagttgacagttaaggctaaccatcacagtgtatattagaacttatttgttctaataaacttagtaattcccatgggtcattagctctacctggtaggaactatctttgtacactttgttaatacaaattgactacttgttttaatacctcatataaaatgacagctgtggcatttgtctttctatgatagagttatttcacttagcatgtctttaaagtttatctgtgttctcatgtattacagaaatattcataatgttaaggctgaataattttcatgtgcatgtgtacagacacatgcacatactttctttgctcatttgttatgagggatcatacaggttgtttccttaagttggctactgtgaatagagctaccatgaagatggggtgaaaatatctgtttgtgatatttagaatggctcttttgggtaaaattcttttgaatactagatcatgtaagagtccaatttttaattttgaaaaaatatttatttttattttgtgtgtatgggtgctttgctagcatgcatgtataccacacgtgtacagtacctacctgcagaggtcagaagagggtgttagatcccctagaactggtgttacaggctgttacgagctgctttatggtgctggcaaccaaacgtaggtcctctagaagttcagacagtgctcttagccactgagccatcatcttctggatgtatttttgagaacctactatactcttctgacatggcatatcattttacattctgtcagttgttcaaaaagcttggagtttccccatatactcattaatactggtttatcaccatcatcatcatcatcaacaacaacaacaacaacaactttattttataatggtaattgtgacagatgtaaagcaatatttcatgttggttttgatttgcatctttcagatgtcagtgactatatcctcgtgggtcactcatatgacttcactgtagaaatactttaattatttaaccccctattcctcccctctccactttttatagtaatgagggttgaacccagggcctcatacatgccaggcaagaacattacccctgagttgtatcagtcagccctactcaatttttcagcctcttttaacatcaagatagtaaatgtgttgctgtttggaaagtttggggattttattacatcttgggagttccttatatactttgataattaaccccttagtggctggatggtttgtaatatttttatcctttttcctgagttgtctcttttttctgttaatgttttctttccttatgtgatgctatattggtctgaatgagaagtgttccctgcaggcctgagcatttgaatgcttggttcctgtcttagtcagggtttctattcctgcacaaacaccaagaagcaagttggggaggaaagggtttattcagcttacacttccacactgctgttcaccaaaggaagtcaggactggaattcaagcaggtcaggaagcaggagcttatgcagaggccatggaggcatgttacttactggcttgcttctcctggcttgctcagcctgctctcttatagaacccaagactaccagcccagagatggttccacccacaaggggcttttccgccttgatcactaattgagaaaatgccccacagctggatctcatggaggcacttccccgattgaagctcctttctctgtgataactccagcctgtgtcaagttgacacacaaaaccagccagtacagttcccagttggtggtgttttggggggaggtttggataccacaagcttgttggagaaaatgtatcactgggagtaaactctgagaacagatagtttcccacatgtctagttcatacctgctgctttgtgcctgtggtccgagacatggctctcagatctctgctcctttcaccatgcccgattgctgccgtacctcacaccatcatggacacttatccctctggaaatcatgaggcaaataaaatcttcttcctataaatcgccttgtactcggtattttatcacagcaatagaaacggaactatgtagatggggtccctgttgtctacttttgcgtctgttgcctgtgcatttggtgatgtatctatgaaatcgtagccaagaataaaggcaaagctctttccccatctgttttcttctgaagttttatcatctggggcatatctttaagtctctaattcatttagagtttgcttctgggcataactctttttctcaatatggcagtgttggggactgaacccacagtcttgtgcatccctggtgagtactacttcatttaatgtttagagaagccccgactattccctaacctgactctccttctcagtcaagtttttattgatggacgcagctccagtttgtatcagagaatgaaggttagcacagtatctgttttcatggaacttctggtaaaatatacatccataggccaatatacatgaaaaacaactacacccctgactgccttcaccaacctattgctggtattttatttgtgatagttggaggtagggtgtgtgcctgccactgcatatgcgtagaggccaaaggacagctttgtgagtagttctctcttacctttcttagcttctaggaagtgagctaaggtctgagggcttgtgtacaagtattttatttgctgacgcacctcaccacccttcattaccaacatttcaatgttccccagctgtatattaaagggcccaagaagtctataatgcagtaacctgcttaacatcactgacacagaacttattaaatttgcatgacaatgtaaaacatacggattagtatataatttaatttaaagaaatcttaatttgcttgcttttataaatgcaatttgttaaattgcctcatggaacagctattttcttcagaggcaaataaaagagacactaatattggtaatcctgcttcacccaggaagagcactggtcctagtcaggagtccagcaccgccgtcactgttgggtatgtctttacatttaagtcaagttcagagttcagagtaagagactatcccagatgctagggtggctttgagggttctgagaacccaaaggtcacgtgaaagatatggttactattgtcaggctgattctaatcagaaatcagagtctggagatggagcagataccattgagaagcagttaggaggtggtaatgtggcactgacaacccagccaaggctcaggtagcggtggacatgcgcatttgctttctcttgtgtttatcgggcaacaagcctgggtgaactggaaagcggatgcggtctgaaggtctgcatgaaaccacagatgtcgatccgtggggggcagactccgggggcatgtgtctcaggggtatagcacttggaggtggcaaggactaatttcaaggtctcacactttaaaagcctaaagtccaagcataggtgggagcccagcctagactcagagcgcagacgcggacagagagcatgctaggagcctctgttggacagtcaaacatgaccgagtaagaccgaaactccatagagacagactgagggaagggagaggttaaagacagggaacctgggctctaagatctccctgtaacagctctccctttgtaagattggatcgaatccctagggtaaggggcacagctgagcttccaggtgagacaagagtagggagaagaaccatcaggtaagacaatatagttagagccccaaaccaatgaaccaactaaccaaccaaccaaccaaacaaacaaataacccaaagaccaaaaaaaaacccctaaaaatcaaaacccaaaccaaaaaacctcaaaacacaaaacaaaacaaaaagacccatgagccacaggaggaacacagttctgtgaaccctgggctcaaacaagggtatggatagaaattaaatgttatatggatggaaggggacctggagaaatcccagtgttttctcttggatgaagactcttgatccctgaaactaagtctcacaagcccagatgaagttgtgagtttaaatcttgtcaagtgtgaaactagagccaacagtcaaatgcctccctccaccagctaaaccagtccattttaacctgtggattaaattgtggtttaattttaggccagaaaaaaatttttacttgccataaatttaagtgctttagatacccatgacataaagactggagcattatgtaaaagggaggcacattagaggtcatttaatgacttgtgccacttcagagctttctatcacatagtccacagcaattcaaagtcatgacccctagaactaaaaacattacccatcagcctttgaactctgaaaccggccaagtgtaataagcccagagcaaagtacagactttccagtgactgagcacaggcagtgactagaccagatcggccatagtgagaccacacactggccctactcagcgggcattcactcagcctagattccattttggttgctgctcacctagtctcaaaaagtctcagctaagtgatgtgacagccctttgtgctaggacatgatctgttctaaatatctttccacaggtgtgctgcaaatcaccgtcaacctgataagaacaatccctacaataaagtgagttatttataccaacatcctcccatgttgttgaaccaatgaagcaaatgtggaagaataatgtttggctcctttctgttttgaaaacattttctgggaaagcaggtgtttgcagactaaatagatatgcatgccatgggtgatagatagtcttagatgtcaggtcagttcttcatcggggacagatctttggaggacactgtaatattggtcatgacagaatagattctgatagaagttggtgtctaaaatgaaaatggcttggagaccacaggtgatcggggagttcctcatggctgttacttataggaagaattcttccctcctataagccctgctccatccagctcccaaagatcaaccagtattaagactgacgttgtttaaagcaccactatctgtccctgtatctactccaacgcattgagccagctatatagcactttttttccgttccccaataaccctaaatttcttctacttcttgttggagatgtttcctttgccccagatgtctttcatccatccactaagtacttccatcccttcctgtactagctaattctttcctcccctccaagactcatcacaccaccgtgccctccaggatggcttctctcagtcctcactcatggactgagaggtgctcccacctcacttgcctggtaggtgctcccacctcacctctgcatgccaggagctaagaaaaggaagttagaacattactagagattcgcttggaaggaaggcaggaactgagatggaaagatggggggggggggaatgataaaccatatggagccacatgaaacctggggttgtgtgcagtaaggggtgaaaagggatctggctaactgggtgttctcaacgcaaggaaagttcataagacaaacccaaatgagaccattaatactgccaggtacagggcaatgtctacaacaacgacgatacagaataacccgtggcctggagaggtggctgggtacatagagtgtttgctaagcaaacaggaggactggaaaccagaactttaggatcatatacattccagatgagcctggcagcccaccaataataccaatactaattaggcagaggcaaggggagctccagggcaaggtggcttgctgaactagcaaaatcagcgtgctccagattcagctggaaaccctgtttcagtgaataagatggaggcaataagacatccagtgccaatctctctttcccacatccacatttgcttggtcacacaggagtatccacatccatccacatgcatgcatacacagccccacacgcatacacatgtgggagaaaaggaaaaaggaaagaataaagtaggtagacatgacgtcgagaagcaatttaagcagggtggatgtgttttctgtccatcccttgtgtgtttgtttctctttcctaagctccactgttcattaggggaaagttcaactcacataaacttttcatgtcttcttcagatatcctcaccttgagatgatgtagtgagtagggtcttgtgcacaaatccctcagggtttggagtggggtatgggtgtcaaagggcacaggtgaaacaaacctggctgtgcactgattcttgtagggtctagggttttatggggtgcttctacttttggggggacttgacaattattcacaacaaaactacaaaacagcgcatcaggaactatgggttcttctcaagtggagggcattacatattaactgaatgcgtacacatgcctttaagatgggatatgcatatgcactgtctaagataccccgagaaggcactgggtatttcagatgctgaacacagattttcctaagctcttgccttcaggccaaattctgcttttcctggactatggcactgtgcagagaaaaattatttgagggcaaggtggtgagaagtcttaaaggccccatagccgaggatggggtagggctgtctcttctcctgtgatcactgaaggcctcttatattcaacagacaccaaatctgagaggtcctaccatggccaaggccatatcccctttcttatgttcagagatggaaaaggaggataatcaaagtgcttaactcacagggtcattagtaccatgaatgtgttaaggtttagtccagtgagttgttagcatcgggcatctgtgctttactatcagagttagtgtttgcgttggagttagtgttatgggtcaatagttaccagttagtcagacacacactatgatggataggttgtttatagacagagagaagacatggttttctgaatataagacggggaaggagtaccagggctaggaatgagcagagaaactatttgaggatgcagctgtgtataatttaggcagggtgtgtaggggaggggagagatgtgaaccaggaagcaaggcagggctggatggatgatggtgggcctggcatggggcagcaaagttgagacttgaagcaggaggccccgaggagccagggagtgacctggtccagggaggggcgagatgaaaacatacttcaggaggattaggctggcatgagatataaagtgtctcggttttgggcaggttcagaccaagggtcgagaagtccctacagagctggaaatttctagacttcctccagcctcaggctccaagctacatttttgccaggctgagtgggaatcctggagttttccatgggacccaacaattcatctttgtgtcttctgttaccctcagctttgtttttgtgttgcgtaacatttccaggtctcaatatcccaagcaagctggagttttcagaggttaaactctagaacctacccagcctgggtggcatctctggaagcaaaaagagacaccccccttttgaccagagatccttgtagacaaatggccttagctgaccctggctgttctttggttcatataacaatactcctctcctctctctagtccttctcccaacctgtttagacacaagacttacataaaccttctccactcccctctgcttcttcaggtggaaccttgaagaaaaaaaaagttgttactaggccaaggagcaaggtttggaaagacacgatgtgctgccaaatccaggaaagcaagttaatgagaaggtgagactctgtccacccactttctttcattggcggaatttttaggtaacaaacatagctccaggcaggtgtctgtgccccactcccatgctgagcaggagctggacccgagctgcaggtcccactcagccattcagtggcttcatctctgcaccatctccagacccctatgtccaattgcacagcagtgatccaggtccttccctctcgaagtccttttgagctctagctttccaggatgcccttctacgggtcagtgtgttggtctggatgagtcctgggtctgaccagaactactctgaaagggaagataaagaaagagccttagaagaactagctgtcctaacaacaggagaccccgtactcacatactaatgtgcactcatgagctcatgtggaagtatacatataagcaacactggtgagcacatgcacacacacacacacacacacacacacacacacacacacacacacacagcatgcatgcatgcacgtaaaataaagcttataaaacaaaacaaaacaacaccaagaagcaagcaagcaagcaagacctagggtttttatacatctgttgtgggattgttgttgttggtcttattgtgttttgcatttttggtttgagacaggttctcactatggaaccctggctgacctggggactgcctgcctatgcctcccagagtgctgggatcaaaggtgtgtgccacccatgcccagctgctgtggattttataggtcgttgatggctgggttttggttatgagtttaacactgctgttgaatgcagagagccttttaaatcgagcatcaatgaggggttgttttgttactgaggggctggacatgggtttgcttaggactgagatttgctttctgttgcctcccttgttctgagcgcaattgcttagctagatgtcgatggcctttcaccatgggtttcctgtgagcgttacaagctgagattggcaggtgcattgaggaggtgggcaaggggaggggcgacagcacaatgctgtttccctattggtgctaagtgctgttcctgtttaataagtgcagttttgaactggaagagaggaggtgtgaaaacaccacacgagtcccctaaaatagcctcttaacaaccaaatcaggagtagaatctggtctccgttcaggaaacagggtgcttggatgtccactcccctggggctccttagcccgtctttccccttaggttcaaaggttcttcataacctttgggtccattgactttacttctgataatatcaatgacctggggacatccaccttacatatgaaggacccctgtcggcatgagtagttgtctattaactgtcaccatgtagtcagcttctctggcagagatgattacaatctaagtctagaatgctgggaccctttaatacagtttctcatattgtggtgacccctaatcttttttttttttttccgagacagggtttctctgtatagccctggctgtcctggaactcactttgtagaccaggctggcctcgaactcagaaatctgcctgcctctgcctctttgttgttacttcatacctgtaattgtgctactgttatgaatcataatgtaaatatgtgtgtttttgatagtcttagcccctatgaaagggttccttgaaccccccaaaggggtcgtgccccacaggttgagaaccagttctctaaagagccatttatgaccccctctttggctatcaggcttctaaaagaatttccctaggaatctccacatgggagaagaaatagccaaaaccccagggacatccagaggaagacctaatgttttgtgaagaattttgcaacttattagatgacttcatagagagttggcgctgagacggccgtgggcagaggccacaccttgtctgaactattcaactatgcatatcttttctttttttatgtaccctcacgtatggaatttgaaatcaaacttggatgtagtggtcactgtatttcctttgtccctctttccattgtggccactttgaataaatctccattttaatttggctcttttatttggcttgttcaggataggtggccaaacctggctagttgggggctcaggttgaaaccctaatctggtaatagtaacatatgtcctgagtctggacctgtacagccatgctcagtaatgaagaacaagcagcatattggatctctcctaaggggtgaatttcacccctgctaaataagcaataattgatcaaacaaggactggctgcatgctttttatgctcctcagtattcgggggcagcctcctctttttcactactccaaattctcattctgacttgagcttagagttgtgtttactccagactcacgcggtttcccttgattattattgtgtgcctctccctctgaagctgaagaaatagctgatccttacgtgcttgtggagtaagcaaagaagtcacatgactggatcagtacaaaaatgtattccgctttgctgtagtccagtgaatttgaagccatggatattttcccttttaaatgtacagttcatgtttagagaaaggaacgcaacgatgtatcaattgcttgtatacttactgtcaaagtagcagaagttaacatttaggctcagtacttttgaatttccttctttcttgaagaaatggagcattacattcatttccatctctactgagaaaaccagggctgagtggccagccatgtgcttgctgtctaaaatgcactgatggggactggagagatggctccatggtaaagtgtttgttctgcaagtatgagatcttctgtctagacatccagaacaacatctaaaaatatctagatgtgatggtgccttcctgtaaccccagcaggggtaggaagggaacaagtggatccttggggctgtctgatcagccatttcaaagaatcagtgagatccatcatgaatgagagaacctgcctcaggaagtaaagggagaggctggagcaatagctcatggttaaaagcactggctggttccagctctagcagcaatctacacggtggttcacaagcctctgtaaccctagacctaggatgtaatgtgcccttccagtctccaaggatactgcatgcatgcatggtgcacagacacacatgcaagcaaatacccaggcacaaattaataataatgatgatgatgatgatgatgtagatagatagatgatagatgatagatatgtgataaatagataatatagatgacagagataaatagataataggtgatagatagatacctagatggatagatagagataatatagttagatagatatagctagatatagtatagatagataaatagatagagatagataaatagatagagatagataaatagatatagtattgttcaatagagatagataatagatagatagatagatagatagatagatagatagaatagtatagtatagtatagtatagtatagtatagtatagtatagtatagtatagctagctagctagatatgagtgtggtagcacatctgggaggcagaaaaggtctgcaagtttgaaggcagcctggattacaaagcaaattccaaggctacatagtgagacattatcttttaaaagtacatatataaagtaaagcagaagcagaaataaggaaggcactgcccgttggcttttgtccacatacacgtacacactcttactcacatgtgcacacatataaccagggccatacagaatacacacacacaaagtctaagaatctagggccaacgagatgtctcactgggtaagggcacttgctgctgagcttgatgacctgaggttaagccttgagaccagctctcacagattttcctctcatctctacgtgcatgcaagtgtgtgtgcgcgcacgcaggagtgtgcatgagaccagtagaggggtctttttgtccattgtcatcactgtcttcaaatcagccatatcaggcacttggaacttgtccctttcatatacttccttagaaatccctccgttcaatgtcacttttctcatttggactggttaaacaattccctggactgttctctagaaagacagatgtgtgaataattaactcaacctcattaatcagttgctaccccggtttctaagcttcaaagctgagttacttgcccttagagcatagaattggtttataaatggtgtatgcattcatgtatgctaaaggaaattatacgttttatagaactgagaatatgtaaagtatataaaatgtactgtgaaaaaaattaagaagatagagacgactttttaagcaaattcaaagagcttaaagtcttattgtagatagtgttttaaatttttttcacttataattattgtgtttgtgtgtgactgtgtgtgtgtgcatgtgtgtatctgttcatgtgcatgttccacagtgtgcatatggaggtcagagggcaaactttcagagttcacgttccactgtgtactcagaggctcaaattcaggtagtcaggcgtgcacagcaagcatctttctacaccgagggatcttgcaagcccaagtgacatcatatcgatactcttaaaagtcattgccttcaagggcaaaggtgatgtcataaaaaagctcgtgcttaagtcagcttaagtcagagagcagcctgcagagttctgtgctgctgacaccgtgctcattgcactaagcctggaactatgggaagctcacagataaccaatacacagacagttccctgaagactgtagtcaaggagacgggtgcacacagctaaacagaccacaagccagcgaagcagatgctgtgacagtcacttaaaggacatgctgtgggtgagactagggagctgggagtaggtgccaatacagcaaaattccttgtgcttaccaaatggtccatcctcactgtcagatggcaggggcatgcaggacacagtggtggtctttgacttggttatgaaggatgaaaagacttcaacaggaagacaaattggggatgaagatgtaggcagtggagggaaaggagaagcagtctaactggggctgaagagataaccagaggacacagtgttggatattttcactgagattaatcaacagttcagtctttggtccatcagcccctcctccacacacacatcccccactcgtttttttgaggtatggttcacgtgttccaggctagcctcaaactcaccaagtggttagctgaagatgaccttgaactttagactctcctgcctgtacttccccagggctgggatgacaagtgtgcactgccctgcctcaggtgtgcactgccacgcctggcttgtgctgttactagagatggaacccaaggcttctggtgttctgggcaagcacagcctggctcacatccccagccctggtccactcttgtctctttccacagtgatctatctagtcttggtcccagcaccttgctcagagggagtggtcaccgatgacctctccgctgtttacctggatggaccctccttagtccctcattccttggcctcttgctgatgtcacttgtcacgtcaaccttgatgtcgatggccacactgacatttgggtcccttgtggtcttcatctgtaacatcctgtccaccgctgtattctctttgttttgttttgttttgttttgtattttcgagacagggtttctctgtgtagccctgcctgtcctggaactcactctgtagaccaggctggcctcgaactcagaaatccgcctgcctctgcctcccaagtgctgggattaaagacgtgcgccaccactcacggcaatattctcttttatctatgttcagatgccttttctctgtcagttcttcctcatcttacatctttatgagcatgtctcctgcagtcttaaggacatgccctctcctacaccatgcctgaattgttcatatctaactttcaggtctcatcttaattattactcaccttaggaacagtttccccaaactttgcatctgtccagtaatgagcctagagataaaactttatcagagataaatgcctgagtacccagctgtcttcctagattagcccatgccattctttagtttctttttttgcataacccgattataaatgtaaaagtcatgtttaccataatattcccagcacttaacacaggctaatcaatatcaagttcttaataaatattcaatgagtaaatatgttattcaggcaacatcaagaatgctgggttgaataagtagggttatataggaagaaacaagagaagaaataggctggatgaagaactttagctttccacttcaaacatttaaggctattctacagataaaactgctatttaaagttgtggtccagtcttcctctagtaacatgctttgttagctggtgtagtgtaaccaattagccagtttagtcaagggttagcagggtagactacaccacaactgtaagagcagcaagacagaaggactgaacagggatggtgcccaagagaatgctgggagttgatagcgaggcaaggccccattcggcatccttttctgccctgttatcattcactaggagaaaagagtgcctaaggaaagccagacttagaaggaagagaggcagagagctcatttcctgatgcagaatcagccggcaggatattagtctatagctcaggggctccctgagcaggagctgtggatttgagagatatttgggaagaactattagatgaagatgtgagggttgtcaaggaaagcagacaaagggaagcgagtcaagagctaggcatgtgtatgaactcaaatagcaacaacaacaacaacagcaacaaatgccatgtatacatggaagagctcgtggccgaaatgacaaaggaaacaaatgttttaaactaaattaaagaaatgatcacgtttagatattgtgcttaaaatcttcaggaggtgaaaggtgatctggaagctgacaccgagcaggggcaaaaagagagcatgtcacagttaggtttagtgggtagaaggtaacatggggatgatcagagaaccactgaagtgggggaggggtggtgatatctttgttcttcagacacagaagagcagaaacaaggactcaggcatgcgtcgtgacagggttagaggcttggttaggtagaaagttaggtttccatgtgtccggggagcggggaggagaagaatgtgttcagggcaaagatccaatgtataaacttttatggccaacagaatgagggctctcagctacagaggaaacacttaatccgcctgtaaatttcagtccgtcatactaacctgacatggcagctggcgtcatcgggacatgagcaatggttccaagcagagttgattgtgcttcctcactctaattattaaccagtcactgtgttagctcattcacgttgagaagcctcccgcctcactacccatctgtatggagacttcttttctacgaaagaagtatgctcattccaaataacatcaagtgtccaaatcattagtttttactctttgttttcatatgctatgggttaagtgcagagctattaaaatacaaaaaaaaaaaaaaaaaaaatctggaatgagccctgacaactgacttgattccaatcttatctgccattttctggctacatcattgggagacttacttaacctctcttaggtcaaactacattattggatgtttcagcccattctaattttttttcttttctcagccttttcaatgtgtatttactacttgaacgtttttcatttaaaaaacaaacaaaaaaaattgaaaaaactcccagaacatctgctatgtgtcagctactgaaggaacacaatgtttaagacctaggttcctctcatgagtcctaagcttgctttagtaggcagtgacagaaggacaaactggtccatccatctagataaacttcggaaagtgaccgtgtccatgggaagtcctccttagacactgtgacccttgagttcagcctcagagaatggatccaagttaattgtaggtgtggaaggttgtgttttgacacaggggacaggcaagtgacaagaaggcactgagttcaagggcacagtatattctaagtgtcagttgccagtggctgaacatagaggagggaaagaggttagagaagccaagttcaaagctcagactatgcatacagtataaggttaaggcactgatcctatagctatgttacctatgaatgagtggtcgttcttgggcaagggacataactcaataggtttttcgcttttccagctgtaaagtggaattgaaaatggtatggcatagcgacctcacatagaagtattcaaaacaatgtctagggcacggttatggttatggaagcctcttgaagggctccagcaagtagagatttgagttgcaggcagaggcaagcgaagagtggattggagagccgtggaaacgggagtggaaagatgttagaaaaaaaatacagcctgcactcaggagagggtatggagatacaggtgaagcagacggctggtgtcagtcttgacagcccatcaggtgaagataggatgagcggtaactaatacccagagttctacttcgaacacatagttttctgtttgtaccctaactacatgcacgcgcgcgcacgcatgcgcgcacgcgcacacacacacacacacacacacacacacacagatacatacacagacagacagacacacataaacagacacacacacacacacacacacagagagagagagagagagagagagagagagaaatgactatatcataggctttggggcagggacaggtgggcctaggtacagagtcctaacttttatcttgctttctctctttctttctttctttctttcttcctttctttctctctctctctctctctctctcccttccttccttccttccttcctccttcctcccttcctttcttctttctttctttcttctttttcttttttcttttttctttttttttcttttctttttgttttttcgtttttttggtttttttgagacagggtttctctgtgtagccctggctgtcctggaactcactctgtagaccaggctggccttaaactcagaaatccgcctgcctctgcctcccaagtgttgggattaaagacgtgcgccaccactgcctggtctacttttattgattttttgatattttccttccctcacaaagaagttgacaaacagcctggcagagctgtgagaactgaatggagactgagtaggaaccgtgccctggatggtgcttggctctcatacctcagatcctcagggaaatgggctggactggggcctagagcactgaatcccctggaaggcccctgttgacaaaatctctccccaaacccgacaaaagcatcacaaactgtgttcttcccagcacctacaggagctacaccttagaacacggatgtttcccaggtgttcttttactgtcctatttctaggaacccgggactcgcacttgtttgaactctagggcgtttaagaagtcactgataaggcagagccagatggaggtgggatgagcaagaactgctactctgaagagagggacaggtgcacagaagactaatggctcagtagacagaaaacccacctctatctacagataagccaggtgacaacattagcctcctcggcagctgtcccctcttctgctgagacctatcgattgacatcctaaatgtcactgtgaaatgttcaagggatactccccacttagcgtagctgctgagccagggaaggcaactgaatgtcttatttgaatgggttgcctggtgctctccagaaaggttccaggctgggacggaaccttcccaagtgaagaaactcacttcacaagcctccagtccccgccctgcaacaagcctgtttgttaacttgaacttgcggtgacacacaccgagttcatttccagtttgcgctccagggcaagtccttgactacacaaagagtgagacagttggggaatttgtggactgtccagttaatcagataaaacccgagagagtcagaaaggcgacttcttggaagatgtcaaagttttactgaaaacagcggaagtgttcgcagctaattggtgctttccttccacacaccccgcactccctaccgccccctccctccccgcctcccatccctgtccagtccccaccccctgaagtttgtctttggtaaaccccagctacttctctcacttgtctctgaggcacaatgggagtcttcatctgaattctagggaagaaaagatatgactccttctagcacgagtgagctggattgtaacagggaacgaattgattgatttttcccccccttcatctcaatgaacacactatgtagccaaaccaaggctgatcaacaacactcaataaaaaaggagattcaaactgaggcccagctgagccctactagacctccacaatgcacgctgtcatctgcttcttacatgtcatcacatttaattatattaatcttcgccataagtaatggaggggattattatgagccttggtctagcaactgggttcaaggtcacttagctaatatgtaactctaaatgttacaagtttctaagccaaggatatgtccttttctcaggccgatgctgtcctgctggccttctaaaatgttagttctctgcctcttgttctgtgcctacctcagtgccccacccccactcctgctccccccccccccattattctgatcacatttacattcccggtctcccattctcctgatcctgtgtgcttacatcagctagaaattatatgcaggacttttaaagagtttttttcatagtattgcctttttgcatatatatatagtgttctttgtttgtttgtttgtttgtttgttttcaaaacagggtttctctgtataatagctttgactgtcctggaacttactacagaccagtctggccttgaactcacagacatcctcctgcctctgcctgacctgtcaagtcctgggattaaagcttgcaccaccacacccagctgcttttatagttttttttttttttaagttgtgtggtgtgcatgttgttgtgttttataaaatagctgtggtataatgtttggggatggggaacatttcagcaggcctctgccaaggcataccccttgaggaatcagtcataccacaggcttagtataaaagggataggggacctggaaaaggggcagaggcagagaaggtgggggacagaggaggacagaaagagagagaggccagctgggaacatgttggggagagatagagagagggaggaagggaaggagaaaagagaagagagagagggggagggagagggaggaggagatgaagaggaagggagggaggagagagagagagagagagagagagagagagagagagagagagagagagagagggagggagggcaagcagtcctttttatacaccaggttggctcacacttggcaagcctcaagctgttgctaggaagctgttggatggagcctaaaggaactgccaatagtgtgtgtacagatgagtttgtgtgtgcgagtctatgtgtaagcatgcagaggccaaagatatcgttctatatgacagggcctctcactgagcttgaagctagtcattttccccaggctggctggccagcaagcttttggaatctgcctgtctctgtcctccaaagatgtggttacagggatacatggtagtgcctggcaatgcctggctttttatgaggatttgaagtcaggtccccctgcttgcatagtaaatgctcttacccactgagccatcacctcagactcatcttattaattgtttcagtgtcgctgtatcgtggacacaaacatatgcatgtatataatagggggagagcagattattctggcatttcgagatcctagcccagtgcaggtgggtggcagtattagcaaaatcactctgatctgatatctgtttattcatgtattcttatctaagtgttggaagaagaaatggcacgagaaagcacagtaacttagttcacagtcacaaagcttggcaactcctagctgggtggtgacacgggctgtacccctatcattcaggaggctcaagcagaaggctcccgagatgggagctagcctgggcgttggagtaaatcccagggtaactttggcttgtgtagtgagttcttgttttgagagactcacgtctggggagccagagcagtagctcagtggttaaatgtactttctgtgaaatcataaagatgggagttcaaatcccagaacctgtgtactgacatactggggaaaacctataaggccagctctggagggaggtggaggcaggaggattgctggagttagttggtgtcttagtcagggtttctattcctgcacaaacatcatgaccaagaagcaagttagggaggaaagggtttattcggcttacacttccatactgctgttcatcaccaaggaagtcaggactggaactcaagcaggtcaggaagcaggagctgatgcagaggccatggaggaatgttctttactggcttgcctcacctggcttgctcagcctgctttcttatagaaccaagactaccagccctgagatggtcccacccacaaggggcctttcccccttgatcactaattgagaaaatgccttacagttggatctcatggaggcatttcctcaactgaagctcctttctctgtgataactccagctgtgtcaagttgacacaaaactagccagtacagttggcttccagcgcagacaggaaaatttgaatcttgattcagaatgagatccgtcctcaaatgaaaagccagaaagtaacagaggaggacactcaatgccctcagtgggcacgcgcacaggtttgtgtatgtgcacagaagatggtatactattaccatacttgtttgtttgtttgtttgtttgtttgtttgagacatggcttctctgtatagctctgggtatgctggaccaggctgacctcaaacttacagagatctgcctgcctctgcttccagagtgttggggttaaaggagtatgccaccaccccctgtggacacagatgtattcacaaattttcaaattgcatctgtttgtttggctagtgcacctggcacagagcgtcctccacatggcatggatgaagacttattccaattggttattgatcaaactaattcatgaaaaagacagctgtctttcacctgcccagacaaggagcaaaaattcatccttatcttatggattgtgcaccttgcacaatccatacaaatattttttataggaataaagatttggttgtaagattcatatattacagaatgaaacagggagatacagctctgacaagattcatccttggggatgctgagatgacccgctgtcccagctcgctgccacatcctgcctcacctgatgctgtttccagagacctgcttccagagcagcgtcaggggtggctgctgattcccatgacatcagttcatccagcctttcagacagatccaccaagacttcagttaagccctgaacattctaagcatacagggactggataacaaatgcgaaaactagctttcttaactctaaccaagttttcttatttccctacacctcccacccccttgaaaaaaattcatcaccccaattcagcaggaagtagttatggagagttgtcatcttgattccttgggtttaggtgtctggctatggttattttaacattattatagatattttaattatttaattattattaaattatagatattttaacatattaagggatactttggaaatgatcataattttagacagggaggaaactagagaggttagacttggagattctgtctttttttttttctttcctttgctctagccttactttcttaggtaaaaggaagggagctgaaatgaaaatggggactagagtaatataggaaattagagatgtgagatggattattcaatttactcttaaacaaaacattttatagttataatctttcattggtagaaatctttacattttgatgcagaactaaagttatattttcttacattggtacagaatttatatatcgatacaggtttaaggttttcactggtataaatctttgtatattgatataaaatttaaaattaattctgttactcttagacaggcattgtgcctatacaactcatttatacaatacaaggcttagacccagtccttctaataggtactgtcacaaatggtttaagatgattaagtgatgcaagttaatggtcagatagtaaactcatgctcatattagattctgatttaattacaataaagtgttttcaagattatcacgtaggaaataactaagagtaatcaatgtttaacaattcaattatattacatatagatagatggtcttcaaaaacatcagaggtccacaaaatatggcatttaaaatcatttcactattaataggtcttttgactaggagacatgtctgctcctaacagtacccccatctcactgcaaagaaggtactgagtatcaatacctcccaattggagttgctttgattgcgatgagctagctgctggtaagaaatagcctaatttaattctacagacaattactgtccagaaaggacaaatggatgcaggacagttgactgctaagctctgccaaaacagagtaagctagtcctttatatttcctgcttcatttatggtctatcagatcgttctggaccagaagtctgaagacaggtgctccaacattataaggaatattgaggactgtccaggcagtcagttgttcctacaaattgtattaagttttagaagctatgtctttgtgctttctacatattctgataattttaaattccttctcagatctctgatggaattgaaaaatagttatagtctcataattgaacttaagttatttagcactaaagaagatgttctagatttgaaaggatggttttctgagggtattgcaagttaaaatcaagcataattgaggtacagatttgtaaattctgtaagttaagatagataatagagtactttatctaaattgtcagatatgatgtactggatgttctaagtgtatatcataccttacaatttacatacttgttataactgtgttcaatgtatatttgggagaaaagagtttttaattggacaaaaggggggaaatgtagctgtctaatgctaattatgtttcctcataactatttgcatgagagggtctgcacatagcttctgggaaccttcccacagttaattctgattggtaaataaagttcccagcagccaatctctggggagaagaaaaagaggtgggtggggcttaggtttcccaggtgtgggacctctgggaagagagaaggaagagagactcaatgcctgaaaggtagtataggacaaagaggcagagccaccctgtaaaggggccaggagagagtggcccagatggctgctcaattgggccaggagaggccaagatggaacatagaaattggtaagtagtaacttggaattattggcgggaggtagagtctagcagtatggaggctaggcagatgcccagctattgtgctgcttaagtcatattaaaatataaaggctgtgtgtgagtttttcattagagatcataaaccattgaggtaggaagtaatgctgtgctgggatttattaaaacattaatactacacttgtggcaatcacaggacagacaacttgtaggaatggattttctccttccaccatgtgggtctagggaattgaatttaggtagtttacagccttggtggcaagcatgttcaagccagccccaatttaatgattttaattaaagttgttgtcctctgaggcacaaaaaaaccccaaagggttcaacacaatcaggattcctgctggcctctcatctacagcttgggccagaagccttgctctgttttgcatttggaatattttatctcagtctctgtaagtcaggcccagggatgggtatagtcagtacacatgaatttggtctgcataactggaaatgtgattatagcttctcagctgttccaaaggagaagcaccatcatatcccattctgcctttgtgtgaaaaactcctcaaaaatacatattagtttgtatctcatatatatgtatacatatacacatgtatgtatgtatatatgcatgtatgtatgtatatatgcatgtatgtatgtatatatgcatgtatatatgtatatatgatgtatatataatgtatatatgatgtatatatatcacagacacatataatttaggtcactttttgtccctatgttttatttctttcaaaacctactgctgcgccttacacagtgttttgagaccatcttctttcttatcttttttttctcacataatatatcctaattacaatctccactccttctagtcctgctagttcctcccctcctatccagagccacctttctgtctctaattagaaaacaagcttctattatatagattataataagacaaaacaacacctaacacaactgaataggacaaacaaaaaggcagaaagaaaagagaagtcacaagaaatagatccacctgttcacacactgaggaattccatataaactctaagctggaaaccataatataatgtgcgaaggacctttagggtaaagagagagaataaaactgcataaataaaataaagtaaaaataataataaaggaaaatccctgacacagcacagtaagacagggaagctccaaagactctgttgagttcattctctgctgaccatctagttctggacatgtaacctacccttaagagtcgtttgtttccacagcaagactgtcttagaggaaactaaattttcatttggaaatggttatcaactggaattgcttctgggttaggcctaggggcttgtgtctacatcttctctcagctctagggtccaatcttgtccagacctgtgcaggtccatgcatgctgcctcagtctctgagttcatatgtgtatctatcggcccttgttttcttggtgtgccccatcccttcttgctcttgtattttgcctccttttccctgagccccaaaggaagggatctgatggagatagcccatttagggcagagtgctttaaggtctctcatttcttacaaatatctgtctgtgagtctctgtgttcccatctgctaagggaggaagcttctctgatgatggctgacaagacgccaatcaatgagcatgtcatcaggggtcattttatcgttacatttttgtttgcttaaaaatagtaatatttggttctaccctaggttcctgaactagcttgtctcaggttcttggttacccaagcagtgtcaggtttcatctaatggagaggaccttaaatcaaatcagatattagttggttactaccataagatttgtgacaccattgccctagtgtattttgcaggcagggcatcattgtagatcaaagagtttgtggctgggttggggtttacctctctcctttggtagtgtgccttcccataccaagaactctggtagataaaggtgaaggctctatgtaggcaccagctcaatttctccacgttcaatgggttgtgtaggtgttgtcttcagcaatttttagggtcacttatatatactatcatatcatctgcaaataaacacactttttcttctttgtttccaatttgtatcccattgattttctttagatgtcttattgctctagctagaacttcaagtgctatattgaaaaggtatggagagagtagacaaccttgttttgttactgctttttagtggaattgctttgggtttctttccatttaagttgatgtggtcttgctgtaagctacctttattatgttgatttatccctaattattccaggacttttattatgaaggagtgttgggttttaacaaatgccttttctgcttctaatgagatgacatgtggttttgtctttcagtctgttaatacgatggattacatttactgattttcatatccctgcatctctgagatggtgcctacttgatcacagtgtattatctttttgatgtgctcttggattcatttgcaagtattttattgacaatttttgcatctatgttctgtttgaatttggtctgtagttttctttccttgttgagtctttatgtggtttgagtatcagggtcactgtgacctcataaaacaaattgggcagtgtcccttctatttctactttgtagaataatttgaggaatattggcattaactcttctttgaaagtctggtagaattcttcactaaaaccatctggccctgggatattttttttttttttttttttttttttggttaggagacttttaatgactgcttctatttcactaggggctataggtctctttaaattacttagctggtcttgattcaactatcataagtggtatgtatagagaaatctatgtgagctgaagagatggctcagcagttaagagtttgctgttcctctgtaagacctgaatttggttcttagaacccagattgggtaactgatagctgtctgcaactgcagttccaagagatataatactctctcttctagacactggacatggcacacacacacacacacaaagttgaatgcaaattaaatggtagataacggtatgtgcacttcagagtttgtggtaagtgacagttgatttacttgatgcaacacagagtcgtctggaaagcaaatcttgtgcaaggatcgcctaggttaggctggctatgggcaaggctgtggggaattgtattagttggttacttgtggtaagacctatcctgattatgggtggcaccacctcatagtctcagtcctgggctgactgaaaaggagtaagctgagccctggcatgtaagtattaattcttggctctctgctcttgactatggatatgatctgactatctgtgttaagttcctgctgtccccactgcccaggagtgatggccctagcctgcaactgtgagccacagaaatcccttttctcttaagttgcttttatttcggggttgggtggtgggcggtgagaccgaggttttgtttttgtttttgtttttgtttttgttttgtgtgtgtgtgtgtgtgtgtgtgtgtgtgtgtgtgtgtgtgtgtgtgtgtccgtgtgtgtgtcctggctttcctagaactcattctgtagaccaggctgacctcaaattcagagatgggttcctttgaggcaagcaacttctgaaggctaggaaggctcaagcacattggctcctgggtccacagtgctcagcatctgtatttcatgaacagttcctgggtcctctgccagggctgtaagaagcacggtgtctgcttaatacaactgcagccaaagaagacagaggtgttggtgcaaaaacacagctctcacatcaaagcaggtaatagtttattctgaagccaaatatgagtcccaatggcctagtaatacagatttaagttacccagcattctgtgtccaatgtgctaagatttggtaaagtttttatggaagcagaagaagtttattacaaatccgggtacttttcaaacacattggtggaggcatcgggtaggtggatcacagcaaagcaggaacaactttacttgaggctcagatgctgacagtgtttcacagcccattggttggccggaaactaagagttcgcacattctacggaatttacctaatggcacatggaagggcaataaatggctgtttaggatcctaaagatgccccaagataatttggctctagacttgcaacattctaacccctctacatcattgacattctaatcagttccgtcagcctttccagggctggggggtaggggaggaaggcaaggctatttgaggaatagcttcactacttgaacaccacacattcagggctgcaaaggacacacaaggctctggtctgtggttactagacctctcatcaattcatgaggttgtagctatttcgaactctggaccatcttgtagaggaatgtgaatgaggctgaatttccgacatgcctttggacagatgttcgtgatgctaactctagtttttgtaagatagttattctcttctgtgaagtgatgaagaatttgacacagttttaaagaatctccgtctctctgactccgtctctgtctcaatctctctctctctctcttcaaattagaggtttggtaatttaggcacagggctgctatatgactctttgatagcctcacaggcatgtgtacttagtgtgatgctcagcactttgaaggaaggaaggagggaggaagggagggagggaggagagagaaaggtgaaaggagggatgaaggagggaggaaagaggaaaggaggaagcaaggaactcagttataggccaaagagttttcaggtttatagacacatagatggttgcagctgtagcctggcagtctacataaaggacacataaagacattctcttggccacaggttgctaaggctgggtaggaagtctgtagaaggaagccagaagtcagtaagtcacagattaaacattgagcaaaggaccacatcattagtcactcaatgctagtgtttatttgtctttctcttttgtttgtataaatggaagtactctctagggtttctgtttaattaaaaatcttattaaatataagcaatgaaactggcttaaccaggaaactgaacattaaacccgttcacaaaacgtatgatctgactaggagaaagagaaatgtgctacccacaccaatcctggttggacatgtgcctaagccgaggtcactactagattcagtcagtacccagagaaggtagcaaacagcctttgccatataactgaatgaagggccagcctcatatctgggtttctaactgcagaacacatacatgggtgtgtatcccaggtcaggttgtgggtggcaaggccttgctgctgtataggggtcagggctcttcttgcatatctgtgtttataacaagagttgcttctgggtggcacagactaggggagacagctcctccttctagtatctttgtcaagggaacacactataaccttccatggtggttagcttaactatttcctgtgggtgtgtcccttattaaaactatatcctaaatatggtcctctcttaggaggcatcccatttcctagtcagtcatcatacatgatatacaaagagaggtatcagggcctgggctccatggctgtctagatgtttctcatctgttgtgggggatggtgcagcatgccctgagctgcctgagtcactgcaggaatgaggaagactcacagggaggagggaccaatttccttcttcagtagagtcagagagctgcataggtgagatctgagctgtgcaaggagtgggcagggcttagatgtagaaaatttttaatcctgacctggggcttctaccctgcctttgactctttagttcccagatagaagacacacacagcctttataattacaataaaccttcaacagcacaagagctgggtggatacttaccctctacgttattagaatctactttcctattgataactctgaattattacttactacttaactatgtttcatctgggctgctcttaactccaattggccagccctcagggccatgtttttatgattcccaaaccatggcaccttctcctttgtcttctgtaccttctagttctccttggttctcctctgacccatgaggtcaccccaaacctctaatccctccagtaattggctgtagagaattttatttaaccagtagctttaaatcaagggacaaggtttgcagaacacaagcttgtaaacaggagaagtcttttgtaggccaagacctttggctatagaatttagcattacaatgcatagcatcagaccaaacctcaacacttagaaactcagcaagggacaatgtgggcaaagacgtggagtgagagccccctcagggaccccatggtcacctgttccccattaaccacaggtctttgggattctgcaaacccccagcaacccccagcagctgctggaagcaccatcccatactccatgagtgtgtatccaagctttgcaattctgaagtcctatgagacaatgtgagtagtgtgtcattgtcaggattcatgtatattgtagacacaagatttaatgaaatctttctattgtcaaaagtgtttctaaaatgtttggaattacattagagcagaaagagctccaatttatgttttgctaggtaccttcccaacttagtagctttatttatttatttatttatttatttattatttttgatcatgtgcaggctcccaaagtgcatgtggaagatcaaaggacagatttgtggagtcatttctcatattctaccttatgtgggctccagagctcatacttaagttgttaggaatgtgaggaaagtgctctacccattgatctatcctgctgaccctttagccattttaaatagcaaccatttctgacagcatttggcatctgaagatcaagaattcaggggctccttagctgtgtgggtctggccccaggctctcaaaaggcagtgagcacatcttggccaaggttatgtcacttgctgttgaaagatcaaattctttgggttcagactccatcttagacaaacttgacttaagtaaattaacaggtcggtacctagctccagtttccagattacccaaaacaaaacctgagcttagctccagtttccaggctacccctaacaagatctggatctccagtttattctcctctaacaaatccactgtctagcaccaatttccaggttaatccccagcaaatcccaacacctccaggttacaaggccgcccctgcctaacaaccaccaattaggaggaaagccaacgtttggctcccagcaccagccaattacaccaaaggtcacagtagcaccccaattagatgcttgctaggcttgaaacactcacccttcacttgtgatttcctataaaaccttgtcccagtgagtgatcaaggaatttttccatggaaccgtcctgtgggtcagcagtgaatcaagacccacgctcgagcttgtgaataaagtccctggtgtgatagcatcggatccggctccttggtggtcttttggagttcatgaacatttcagcatgatactgtttaactggcatgggcattcttcttgtggtgggcatctgttcttcaaatggcgcatctctgtgtgagtgagtgtctctatggcatggtggttggtcgccactgaaatgacttttgtagaagagcaaacagataaaaggttcttttgtgccgtagtctctgtcaaaccatcacttctgctgtattttatcggccaccctgagcatccttgatttgatgcagaagaggattatgcaagcaaataaataccagaggatgtgtaccactgggaaacaaggcaaggtcacctctgaattcatattctgggaagattagagctttcagaacaggagctgggcacatgcctgtaagctccacactcagaaggccgagcagatggttcacaccagtctcagttacacaagtcagttaaggtcaacctgggctacttgacaccctgtccctacaacaaccaaatatacacgcatgccagagatgatatagtgaactagacaccctaaaaaaatttcacctttaacgtattgaaaaatactgagtagaacattttaaagatttattttggtttttaaatgttatgtctgtgtatatgtgtctgagtgtatatcgcatgagtgtatatcgcatgtgtctgagtgtatatcgcatgcatgaaatacccacagaggacagacaatgtcgccagaactctaaaactggcgttacagacacctgtgatccaccacgtgggtgctgggagcccaatcctgatcctctgcaggagcaacacaagctcttagtcactgagccatctctctagccctaagagtcaacaaataaacacacacacacacacacacacacacacacacacacacttaaatctttaaaagctgccccattatactatcaggagaataacaggtaaaaccaacacaggaggaggtgtggattgagagactcgcggagttgcaggctctccttctcctgctctagttcccagtagcttactattcatttaacaatgtttatggccgtttgctaggcctattcctcatctaactcctaacttacttaacctgtttaaactattctatgtctgccacatggctggttacttctcagtatcatatatctaatttcctcagagtgcaggtggtgaacctcccagagtttcagtctgtctactggaactcccagtttctacttcctgcctttggcaaaaaacaccatgcggcatatttggttttaccccttgacctagaaaacctcaagtgtttatttcctggccctttattttctaaaatgccaataagataggccaccagatctttaatgacaggtgatgcttcgacacagtacctgagagattatctctacagacataagtgcttaagctgggggctcctctaggcacatccctcaaccaccaagtgacagggaagcttggtgagtttctttcacatggcaacaaacaaggcacctcagctagcaagcaggaaagcaggagataacatgtgacggatgtaggcgtcagagcaaagacccttccagaaactgcctcaaatctcaatggatatttctcagtgatagttcacatcaggctttttttttttttatgagtactatttttcttggtttattcaataggctgcttcaatttaccttaatgtccacttatacttatatataagcttcttttatacaagctcagtggactcactgagaaagcacaactaggaatgcaaatcagacagcaatattaatacagagttcaccttctcctttcaatggaataaataatgcgtgcatttgtctctttctaaatatttaggcaccaaaagttttcatgggactctttcttttttattttatttacttattaggtattttcttcatttacatttcaaatgctatccccaaagtcccccataccctcccccctcccactcccctatctacccactcccacttcttggccctggcgttcccctatattggggcatataaagtttgcaagaccaaggggcctctcttcccaatgatggccgactaggccatcttctgctacaaatgcagctagagacacgagctctgggggtactggttagttcatattgttgttctacacatcaggcatttcttaattctctttccacatgcaaggagataaaacctttcctacttctacagtagctctgatggtcagggaaagtcaggaattataagcagagtctgggtttatatgggcttgcagccacgctcacccagcatgagttacagaaacctggctgatagtctgtttggaaatgtgacccagcatgagaagtgttctctgtctagaaacaaacgggagtcctgttgaagcacatgatgtctttggttttgccccttcgtttagaaagcctaaaaagattattatctggccctttatttatttttaaataaatgtcaatgttagttgcagaaatacctgcatagaagcccccagttagcctagagttgaaatacaggaaagatgcatttatcaaactaccctgtgcagcagaacaaactgaattagagaccggggcaggaggaagcttggttagacacagtcttaggcttggttaaaaaaagggggggggggcgttatgcattatgtacagttaactgggtacctgaaatagaccagacttgcttctgagcactgagggcttaatggttaactataaggagcctagggaggaagattggttcgagaacatagttactcctcaattgtgaatggagttctgcaaacagagaacattaagaggaacagaaaaggagaattcttttggaataatagctctctgccacatgtacccaggtgctctgatccccaaatacatcaaagctgctttgtcacccagtctgtgccagaatgggcttgcacaatgcatctgagcaccgagtgctaatatgctctcctgagagcagcagtggggagagtctgagctggtggcagtgagctagctgcagattgctctgggctggtggcagcaggacaagtcaattaggggagtgattgggagaaaggaaggcaagaggcacccagagcctccaggctcttgtttgaaaaatggaagacacacctggctttttccacatttccctaggtgctcgctagggcctggtcacctgctctcctgattgactcagcagggattgggttgtaaaattaggggctgggtgatgaggcagcaacttccgagtgcctattctgtgcatgtctttgtacatttatcaaggccctcaaatcaccctcacagagcagatattggccccttgttttgcaaatagggataccgaggtccagagagaggtactaagactacaaagggagatgccacccccaaatccttctttctttatctccaagtaattctagccaaggaccacatgggagggtgggtgggctcagcccagctctccttctaagaacaaaaaggacttatgatgtcccctgggctccccatttctctgtgagagtttttaggctcaacccatgaggcctagaccttcctgagaatggacaggcaatttatggtagctgaggaaaggaggaaacattttctttagctgtgtgactgaccactgatgagtggcacatgtgcctataaactcactgggtaacatacacagaggggcatgaaaaaaagaggggggctagttgagaagaagggaggggatcaggagtgggagggagagaagaaaggggagcgatgggtgaatatgatcaatatacattgtatacagggatggaaatgtcatgataaggccattattatatataattgataaatgcttttacaaaatcagaacagaaagataagctgaggaggaagttcagaatcacaaataagtaaaataacaacagggaaaaatctttctcagaacgttgctatggagatagccacatgctgtgtgagtggagacctcaggttttcctattgggcaagatgcattgagtagctacagtcagggaaagccaggaggtctgaacctcgatgccagagagcccatgcagagttgagaacaggaggaaggttctgaggagcccggagggtggatgtgggtgacaacttcagaagaagaagggcaggctggaagccagtatatggagacagatgtcattcctggacctcacggctaccttgctgagctcactttctgccagcaggagaaacatgccctgaagatgtgaagatgccagagaccggtacagaaaagcgagaggagcgttgttgtggttggttgtatgtgctgacttgatcaggctccagggtgctcaggtatttagaaaagcatttgtaatggctgtgtctgcaagggtgtcttttgatgtgtgctaccgtgacctggcagagtgaagtatacattgctctccccagccctggtggacctcatccaacccattggaggcctgtgttgtgcaaaatcgcagaggtaggaaaatgtcttccctctgcctatttttgagcgtgagcgtgaatgctcttgcctgtggagtaagacatagactggaccttacctgtgttagacctccatgcttcttggattaggatttggactagaatttatcagctgttctgggtttgctgttgtgacccacaggtcatcacactcctcagcctctgtagcactgtgagaccattagttataagaactcctggagttggagagatggctcagaagtgaagaatgcttcctgctctttcagagaactggaggtcagctcccagcagctgtatcaccatcacgtgacttacaaacacctgtacctccggttccaagggatcaagtgccctttcttgcctctgtgggcacccagacatgtgcataaacgtacacagatatacacataaataaagtaaaataaaataacatgaatcttaaaggaagaaacccagtcaatcatcacccatcctgcctgcatcctcttggttctctttttctctgggtcaaatggattgccccatacaagcatcttcttgctgccttctctacaggctggggctaaacagggaagttatgggtggggacaactttcagacagatcaagaaggaggaaggagcgactcatgattttcaaagacaacacaaatgttggcagtttggggatgtaaccgatgagggcagtggactcaggggcagacccgtgcgcatgcgcccacgtgttgccatggcaccaacaccatgcgctcaatgggatctagccacacttacgttaatgctctggtactacagagttggaacttttagtaagtttgagcgaggagtaatatatcagtggtgatgagcatgcagggttaggtcccttagagaaatggtgactagggtgggaagtgacacagctgttgccatatcaaggctagagagttgctccaccgaatagccataagtcctagtatcagcctcagagttcaggaactctgcttttcttgtttgtttgtttgtttgtttgttttcttcagacgattctgtgaagggaagatggaaagtgttaattatataaactgaagacgtttccctgtgaagtaaggccagcccatacccagccttaggctaagtttcacttgccctttcgcaacacaaacctttgtccctagatctgactaagaggttaagcaatgtgaataccggtggccaggcccttcctctccccagaagagagaagaggtccccgaggcagcagatgtgagtcaagtgccttgtggtagaggaggccactggagtagacctgggaaaaggttctgacactgtttatgactgttgggctgggcttgatcagaccaagcaccaaacgcagagctatgtatgcgcagctctgaccttcctccagggaggatttcaggatgggtgctcatgaggctccactcctctatgagtatcggtaggcaggattaatggttgccccagaaaagtaatgttttcttcagtggtgtagctactgataagttgcccatgtcattgtaaataacccctcactcaggctcttgtgattaattcactggggcacatgacatcaatgacatcacacatacacacacacacacacacacacacacagagagagagagagagagagagagagagagagaataataaaaaaataaaaatttaaaaatcatctagtctttgttaataaggataatatacttggtggtatacttaaaattggtggcaaaaaatcatgcccgtaagtaagcactgtctgagggcttgcgaaagtttctaaacctgtagttacaggcatcctcaacaaaaggcatggcaagtcattgacattagtgtcacccaggcacacagccaactcaggtgggaattgttggctctgtaaggacaggcaaaggaaaaggtcacactcaaatggctcatctctgtcatccttagtagaaaaaattgaaaatgatattagtcaagaaaggactaaataagatgatatgcctaatattcagggagaccaggataatgtttcaaatgccctggaataactggctctgtgtgtgtgtgtgtgtgtgtgtgtgcgtgcacgcgcgcacgcacatgtgagtgcacagatttatgtctgaatggtcttcagaaattaggtgatattccacaggaaggattttccatcctatcaagaacctaagaatatttcaaggaaccagatcactatttagggaagagggaaggtcgtgtattatattagccagatatacttcactcagatatgattttggattacacatggtggtgcacacctttaatcccagtacttgagaagcagaggcaggacaggagacacccagggccaacgagacccacatgaatgcacaccccctcatgtgtcagtgagagctctcgcacactctccctctcataatgagaaatgagaaaaggagaaagataaaatatctgctattccttgtattagtcaaaaaacttcctgcgtttgaggatagcttcgtgtgtacttagatatttagaaagtctcaggtaaaccagtgcttaatagtttgtctcaaacaaacaaacaagcaaacatgatttgaaccaatggcattgggtaggaaggctttgggcttcagataacaaagctgaaggaaggtctgctctagccacagctgaacgtccagtcctcttctctaacaggaagtctgcaggaagttgctctccaagtccacgcagcacttccagggcgtaagcagctcagagtctctgaacttgcctgcttgtttcgctgcttcctcttccactccaggtgggaaccacggctttgagcgacagagtctcatatgtcagcttcttgaggcaggagagagagagtgataatgctagaggattgtcttcccccttcccccccccccccgccccactctgacaggaagagccttcgccaccgtgacaacctgcctgcgatcatcttaacttagtggatagaccctcagacgagtcactggctgacaaatatagacacccatgattggcttacagcatagtgttcattgcttcctttcttttccatctgcagtccagtggggaccattaaaactaagtcaaagggaaaactattcatggttttttaaaatttttttaaattttaaagagagaaatatgaagggctagggagatggctcgggggtcacgtgtgtgttgtacaagcatgaagattagagtattatcttcagcaagaaggtaaaaaacctggatgtggcaagacctgtaatcttggcactgggaggtagagaccgaaggatcctgaggcttcctggtcaatcagcatagagcttcagatactgtgagaaaaccaaatggcagagagggataaaagaagatccccggtgctagcctcatggacatgcacacaagcatgcaagaatgcacacgcgcgcgcgcgcacacacacacacacacacacacacacacacacacaatcataatgagagtagagaaaagtagaaagaaagacagtttattattccttgtattggtgaaaccctccactaaggggcaaaagctattgtacaccatgaacacctgcaggctcaacccttgggtgcagagggagaagactgcacaatgaattccacaccaaccatggagaaacataaattaacgaacaaataggaaagcaagcaaaaaaaaaaaaactagactggaaggagggattctgggtcatggaaatatcattcgccattgatgaattttatttttatgttcatttttcagctccatccctactccttaatgtcgctgccatgttcctgtgctatggtaaatctcttgatttaaaccaaaagctttccttacttcctttcagaatttcacttacgttactctctctcctctccctcacttacaatgaataatcttggaagaaaacatgtctgcatagaaaaggactttctggttagttcataatgttgttccacctatagggttgcagatccatttagctccttgggtattttctctagctcctccattgggggccctgtgatccatccaatagctgactgtgagcatccacttctgtgtttgctaggccccggcatagtctcactagagacagctatatctgggtcctatcagcacaatcttgctagtgtatgcaatggtgtcagcgttcggaagccgattatgggatggatccctggatacatcactggaaagagaggcccattggacttgcaaacttgatatgccccaggacaggggaacgccagggccaaaaagtgggaatgggtgagtaggggagtgggggtgagggtatgggggacttttgggatagcattggaaatgtaattgaagaaaatacgtaataaaaaaatattaaaaaaaaaaaaagaaaaggactttctaccttactggcaactgtaggctcttaggcgagggctctcgcctcagtcatacgcgtcttcctctctgtaaagtgagctggctaaattagacacatccgaaggtcacatagccccagttctgaaacttgatggttctaaagtctgcggggacaagcacatgacccttctccaacctctggtatcaggttctgttcccactcgttttattcattatctgctctgtcccctacttaacccagacttatttgtgcagtctctgaatgagcaagccaggctttttttttttggatgatattattagatgctcctgaatattctccaagtgctttaaatgaaaactctggacagtacagccagacttcccaagttgccaacttgtcccaggccttagaagtcacctaattacattgaattctgcctggtggagatgaagacagaaagcctgtcactaatggtgcatgtgttgagggtggtgaccactccatctttattgccagctatgctaaagcccttgctgcatcagaaggagtgtgagcttgtaaagttccgagtctgcagcatgatcttccattctctaagcggtaaggcttaatgtgtgtgtgatgctgaccagtgaaggaagattctagcaatattctgaaagtgatagataagaaatcaatactaaaatccatggctgagaatccgtctttggttaatgggtagccacagaaggtgggagagagatttctggatacttcaaggagcagaagaataagatcagccagaggggctgctctgagcatcgattgctgctgctgctgctgcccctgccgccgccgccgccgcctttgtcgtctttgtgtattttgtggcgctaaaagaatagcaagcaccaggcagcttctaatgaacaaatgcttgtgattctggaggccaaatccaaaactgagatactgacatctggaggggccttctggctgtgtctaatatcgtagacctcatgtggcagaaccacaaatggagagagaaaactaaaagggtccacactcactcttcactaggaatccactcctgcaatggtggtcgtaatcccctcaccccattctttcagctgaatcttttttttttttcatcaggttctgccgcccaacgctattgcgtagggagtacttctagcacatgcttatgggagtgtgttatcatcacaagagttggtaactttcaaggagacagtgtgagggaaggctgtagaaatatttaagaggcaacagacttggtcagtcaatgaagccagaactctaaggggaagtgtgatgctcactaaaggaaacataaaggactccacccctaccccccacccccgggtgaacagaactcttctgtgctgtcccagccttgcacaacagcaacactgataccctactcccacagtgacagaaaaggacttgggactcctatgaaggacgagggacttgactagagctcactaccttgacctttcactgttagaagtggcataaggtgaagagctacagcttaggggctggagtgatggccacttgctgttcttccagaggacccaagttcagttcccagcacccacatcaggcagctcgcaacaattacccatgattgctaccattgatgctgatgccttcttccaacttctgagggtacctgcattcttgttctctctctctctctcatctgtaaaaatcatattaagaaaatatatatttgggtttaaaatcaaaatggaagatacaggttatagagatatatttagcaaaggaaccaagaacacttgatttctgtgccagagagtcacactttcctcaaagagctcccaaggagaaacaataaaaataaatacagctcttactttgcactagatgctgttaggagcactttaactccattagctgattttgttcttataacagatgccagggcaagagaaagctgtatcagtcacttgagaattgaagttgatttcatggcaggcggtgggacagagagaggaaagtgggctggtccttacaaagcacagatgcagaaaagttacactgggagacaaaaatgagaagagatgcagagtagcctggctagctggctgggttcattcatttactcattttacctttattgagatggttagagggtaagtctgtgctcaccatagtgacaaacttttaaatgatgcttgtgcttcagccccctccagtatcacctcagtcttatcattcgaacacttggtcctgacgggctttgctttttgaccttgtacatttttttaaaaagcgatttttatttctttttatattatgcctgtgtgatgtaattgtcccacatgagtgccacggccacgggagcctgaagagagtgtggcatcttctggaactagagttacagatttgtgagccctgtgtgggtgctagaaaccaaatccaggtcttctgcaagagcagcaagcactcgtagctgatgagctatctctgtagcttccggataattattttgatgacaaatgtctacctgagcctccatttataacattgcaatcattcctagagatgtgcactagtagatttgtacaatagagtgcaaatcagcatatttcatgaagacttaaaagcttaaggtccttcagccatttggaatgggcaaactgctgggacatttataccatgcagtgttgtatagcagagaaaatgggtgaatcatcattacatgtgagtgaagggctggagagatggttcagtggttaagaacatgtactgctcttacaggagcttagtacccagtaccatgtcaggcagctcacaactgcctgcagttctagctccaggcgggaatcgaatacctctggcctctgagagcaggcatataccaccatacacatatatgcataatttaaaatgaaaataagttttgaaaacaattaaaaaataacaggatgaataaagactgaacaacatgtttgagtctatgccggggcctagcaaacacagaagtggatgctcacagtcagctattggatggatcacagggcccccaatggaggagctagagaaagtacccaaggagctaaagggagctgcaaccctataggtggaacaacaatatgaactaaccagtaacccggagctcttgtctctagctgcatatgtatcaaaagatggcctagtcagccatcagtggaaagagaggcccattggacttgcaaactttatatgccccagtacaggggaatgccaggaccaaaaagggggagtgggtgggtaggggagtgggggggtgtgtatggggacttttgggatagcattggaaatgtaaatgaggaaaatacctaataaaaatattaaaaaagaaaaaaaaaagactgaacaacaaaaacaaaccagaagttccaggagaatattggctccgcactttatcttttttaaggtccaaatgccaaaacaggtatttaggtagttgttgtctaagccatttgttgccgatttaagtaaaagtccatccattttctgtgcctgctaaaattgatacttttaaagcaagaaaatgaaacaggaggaaattcaaggtggaggatgtctcggtggagcaggagggcgtgaagagagagcacacggaagtgaggctgttgaccgtgttctcactgtgctgggcagttgagacatagatacttatttggaaaagaattaaactcgagggactcagtggaatggaaaaagtcagctatgggtggaacaccagaccatttcatgaactgggacttgtaaatgttctcattctggcacctgctgagctcctagtgacataagagacctaagctccagatttattccgaattaacaaattgagccagatcctcagatctcgtggaagaacaagcaggtgctctcgactaatgagccacctctccagtcccaaggtatagagctttgatctccatttttctttatgtacaaatatttccctaggcattaaaggtgtaatttccataatctattcagtgtatcaggctgtggtcatactgaataagaggttttcttcacagaagcatcctgtacattaaatagaaagatcaattttaaatgacacctgagcttactccagtgtctctgctaatttgttgaacttttccttcataatctctttaaattaattattaactagcccaaagcagggtggacttgggcattatagagtacctggtcaatttagaaatcgtttagtccaagtcattagaggattattacccttttttttttcttcagccagatgggggatgtcataaatgtacacaattagggttctttaaattaggcttatggcttggatgtgaaatgtcccctagaagctcacatgcttgattacttggtccccagctggtagcactctttcaggaggttggacagacacacagtctcattcatagttggtggggcatagggatgaaacttgagggttacggatcgcctctgattctgtcctggttgctctgtttccagatccagtcacatgtgagcaagctatctcacactcccgttgtcataacggactggttctgtttccatgtgtttctcatggcggtgatcgactttatcctctgaacctcgtgcaaaccctccatgactcaagttggtcctcctattaggtgtttgccctctgtcatgagaagagtgacacccatagtaggctcctttccatccatctcgcatgtgccccacggtcaggttctgttggtctaaggctgaccatcaactgctgctgaacatatatatatagttgagaaacttttccagtcatactttccaagaaataaataggagcttgagtgtggtgagctgtagctctcagctggccactgatgtaattattaatcactgcatgcaattaattgggacctttcttagacatgtttgccactgatccctgtttccagggagtttcacaaatgttcccaccccagcctcgtacctctatttgttcttttgtaactttataaaaattttaatctatacaagtttgcaatgcattgatcatatctattcccaccctcaccttcctggttatccgagattctccccaccatatccctttgaagtgtcagatcttcctcttctgctctttataacctactaagtggtgttcatatgggcacaggtgtaggaacattcaccacagcatgagcaacctgtaagagaccacattcctgaagaaaactcccctttctccccaggggacatcaacggccaataactctcagttatggatggggtaccttccgtttatcctggaatgttgactggatgaatctgtgtaagcagccactgctgctgtgagttcgttaagtgtaatggcctcatgttgaagttaagccctggatcttcctccaagctccgtgctcccggaaataaggctcagactcaaaatatatttacaaataccttggccatgtaactaggctcttctctgactagctataacttgaaataaccattgattctagcctacattctcccatgtgattggcgatatgagctcaggtaccaggcatctgtcttgtcacatcttttcagtgactctctctgcctccttctctcccagaattctttctcctcccacggttcaccttctatttcctgcctaagccatagcccatgggctttttagctgacaggtgatgcattcatacagtagacgagatgttctgtttatagccttgccatacccagaagacactgtgtcacaacagtcactccccatcctgacctgcagcccttatgaccttttggccctctctttcacagtgttccctggggggtggtaatggtggtggtatgcatatatgtcctgttttgagagcaccgcatggtcattccacatttgttcttaagtggaagaaagcatgatgcaaaacagaaggagtgagctagactttaactggatttaggggactttataagagaaagtaaaaacgtcctcaagaattcattaaaaatgaagagcatctcccccatgctcatttctgttcattacaaacgactcaactattacatgcaaatattactctaggaaaatagccacccactgatatgggtgtggagatctccaaagacaagaggaagttgaaaagggctcagatggctcctccaatgtggccttccagcttatgacaagagaaacacaattgctggtccagggacagatgtctgctgcacttgctttgttcctggctctccctctgacccaatttacagcccccctgcagctgtctcctgcatactttcccacgtgaagttatttatctttcttaacagtcaactcgatttattccaagagaatgctcccctcccccagctctgctggtaatctattcctgcactaaattgccattgtaatcaaaattcctagaatagtttaagttggccttctgcagctgcagtcacctctgtcaaagccctggccaagcctcctcagtgccctggagtgagtgtcattccacattgctggaaaccacaccccatctggctcttcccgcctttccaggctccttttgctgtgtccttttatcatctctactgaaccactttcctgacaaagctccaacacggttcctcctctagagctaccgacctcttcaactcctatgtggtcatttttttttctgtccttggccatttcttaacccatttttttaggacatcctcttctctccttgaaacttggtcagatctgccaccatatgtaccacttactcaatattttgatcccggagctcagttccgtggtggctaattttgtcaacagacaacatctggaatcatctaaaactcaagttgctgggcacttctgtgaggcagttttttaaaatcagattatttgaagcaggaagacacatccgacatccgggccccactttctgatggcagcccagataacatgacgtggaagaaggacacttggcttttttttttttttttttttgcctgcttgccccactgtgtctggcatctctcctgttgctcaggcattccttcactattcagaatcccaacaaagatagaaaaccatctgctctccaggaatcctccaggatcccagagctaggtgaggactgctgagacacccagccttgtggactgaacagctgccagtttagatattggtctttccatcatgagactgccattgttgaactactcggaccatatcctgtaagccagccttataaatgcatacacacacacacacacatgcacacacacacatgcacacacacacacacacacacactcacactcacacatgcacgcacgcacacacacacatgcacacacactcacaaatgcacgcacgcacacacacgcacacacacacacacacatacacacattcactctcagttctgttccttcagagaagcctgactaaatcaggttcccagcacctatgatgggcagttcacaatggcctgctaatctagctctgggagatctccttgcttcttctcatctctgcaggcactgtactcattgtgcacacataaatactaatactaataataatagtaatgaaaattataaattcatatgcataccagtttttattagttggcaacagattgcataaccacaacaccacttcacaaccagaaaattgacagactatactagtcatatccaggtttcatagttttgccctgtgcttagacatgcatattttcagctattcattgattgcttgccatactagaaactgacctacacaggctaagccagtgctctaccgctgagatgtatccccagccttctggttccatctgacttaagttgcccaaggtagcgttgatcccaatctgtaacacaggcatacctgaaacttgcaatccttctgcctctgtcacctgcgtagttgagattttaggccggtgccactctgtctgtaactttgttatgtggagagactcgtgtgcctctctatgagatacacttgggaagaaagaacctgccggttaagggatggcctccatcaggttgcctatggggatgtgtgtggtaccttctctgtccagtttactacggggagcatcttccctaggcaggtcgcttaggttgtctaagaaagctagctgaacacggagcaaaccactaaagggcatccctctgtggtttctgctttaaggtcctgctttcaatctgtctcctgtcagatgaaacaaaccctttcctctccaaattgcgtttggtaatggtgtttatcatagaaaaagaaaaccgagaaaaagaaaaccaccatagtcaaacttagactcgtcccatcagtggcctcttgtgataccttttagaaccaactgccacctgtcccttctcccgacctgtgaccagcaataatatgtctccagatttatactttgattaattttaagaatgttgcataaattttatcaaacaccatacggaagtctgaaatttccctccccagcatgattctcttgatatccacctgagttgttgtgtagaccgacactgttctcattgctattggtgagtagtatttctgaatgtggacttggtagtttgtctaattgctcgcttgttgtgagatgcttgggttatttctagttattgaaaatcaacatatatgaaaatgcatatgtagattttgtgcactttcacttctcttggataaatgccttaggaaaatgttttctgggtcatatggcaggcatatgtttgatttcctagagacatcaatgcagtttttagactgattgtcccattttacattctcagtagctgcgtatgagtctgacatccttgccagtgtttgttgatgtccttaaattttttgaaccattctgatagtagggtaggatctctattttatttatatatgtgagtatgtgtttgtgtgtgagcatgcgcatttgtgcatgtatgtgtgtatgtgtgtgtgtgtgtgtgtgtgtgtgtgtgtgtgtgtgtgtgtgtgcatgtgtgtgtggaagaccatcctcacccttggagctggagttataggcaattgcgaaccacatgagatgggaagtgaactcaagtcctctggcagagtcctctgtgcccctaaccactgagtgacccctcaactccttagtgtatcatactgtatgtttactgagtgtttctatgatggcttatgctgttgatcctcttttcatatactactttgtcatctttatagcctctttagtggcagatctgtcttttctaagtttcctagtctaatattttaatcactgagttttgacggttctttatatgtcttagatagtgccaacctccactctgtttagatgagcagaaggtctatggggttaaaaggctttttcagtcatttagcaaccgagaaaggaaagatccaagtctgcccctgtctttatgcagtctttaccatggctcatctcatatgtagtgtcttcccaactcatcaagctacattcatcttagcatacatagtctcccaaaccaaaaacccataaccagggtatacatccttttggtggggaattgtctgaagtttgtcttctaaagtgtccagcctgtgttagtcattgtatcgccctatatagtcaacaggggtggggatggaacacaacacctaagtatccctttagccccgaagagccttcagttgtcactcctcatcaaaactatttaactagagtcatctcattcaaattcaagtccccttgccagattaaaatatagctgatgagtagttatcatgaaggtaaagaagccagtcacacggctagggagatggtcaatgggtaaagtgcttgacttgtaaaccctaggacccaaattcatgttcccagcaaccacataaagtcaaacgtggcatcttgtttctgcaagccgaggtgtgaagggtgaagaagtgaatcccagggacttcgggtgggtcaatctagttgaagcgatgagttccaagtttagtgagaaacaacgtcaaaaaataaggaagaaagaaattgaggaagacattgtgatatcatcctctttcgtgtacatgcacatgggtaggtaagcacgcaccactcacacacacacacacacacacacacacacacacacacacatcaattcttcatagctctaagtggattctttttgtcaaagaatcagctgaagcttaatggagattgcatacctgagctcttgtcttctacagggattgtaagagcaatgcccagatgactcttatgtacacagctgtcccagagtctgttttctaatcactcagcctgtgaaaactggtgccatccatgacttgaacaggctggtggtcttgggagccagatcactttcccagtgggcactgaggagctccacctgccaccagatagcagagtactgattaggccttgaaccagaaatgaccagaaaagcatgttatagatgagaatagtacagtggatgtcatgttctaggtgtctgagaaatatggaggaaaatgaccctaatcataaagaaattatagggtagatattaagcacgcctaaattattaaccagacaataagaggacatgagagattaattgaaggttaatagctcattgtgaaaggcaggggcctctctggtagcttataaagatgctcttggcttttgcaacctgaggcctgagaaattgtggcctatgacttaatagtaagaatggtggaacaacaatgaagggttaagacctgaagtgaggccatgtcataagttgttgggccattgtcctcacccaggttaggaaacaatggaatttgacacatatggcaggagtggattatgtcaaaaacaataaaactgaattgaattaactgtattggatctagagttgttttttttttttttttttttttaaattctgtgctgtaagcttccagaaaaggcatactccttcctgttaaacaccagtgctcttctgatgtatcaggactgtattagttacctctctgtgactgtgagaaaacaccatgacaaaggcaatttgtagaaggacgggttttactgggttatagttccagagagataagagttcattatggcaaaaagagaaggctggagataggtatgggagctgagcaggaagcgcaaaggccaatggcaaacatgaagcagagagaacaaattggaagttgggtaaagctcaatgcttgttgttagtgatgcacttcctccaggaaagttatagccccacactcccatcgcctctccaaacaattctgccaacaggggaccatgtgttcaaatgcctgtgggagatagttcacattcaaactaccacaaaaaccatacagtgctccatgagttaggaaaacatgcctgctttaccagattctctcctggtcaccaagctaaaccctaaggatatatcaccacaacctggcagaggactgagcttggtctggtaatggaagaaggtataaaccaaaaggaacatcaggtcctagccattaccataagtgggactggattgtgtaagttttgcctcaaaggtggcattattctaagttagatgatggaggatctgtttcttgaggcagggtctccttggatacaggagttaccatctatcaagataggataaagctgtggctggcatgaatagaatcatgatagatgatttaaagcctatgtgggggatggaagcagcctcccctaaagtaaaagtggaaatgcattattgtcattgctatggatgctttctgggcaataaaagacagtgggatatgacatacagctagaagtcttatttaataatttctattatgatgctataatgcaaagcatggagatacggacagatacgatgagtactggtataattaagaaattcagcagtaaatagctcctgaagtcatttctaatcagagatgtcattgtggagattgtggagattgtggattgtgacacagataggaagatcccaaattaacagccgcaggggttccatttcaaacttagatgccaggtgacagcatttaccaaaacagaaggtcaagtgcaaaagaacaatcaggagatctgactccaagataacaatggcaattgtcaacacagcttcctagcgttggggagaaaagagatgtcaagagacaataaaaccattgcacgcaccagagcaagaggagccaagagtgtatgagcaagatcctagagacaaggtttctccacagtgtgttctgtcacccaggttcagagctggcccagttttcaaacacagaacccaacgatgaagtgatcaggtgtcctggaaaaaaaaaaagatttcttcaaaaccatggtgacttaacaggtaacaattccctgacacttccctgaagcaatcttcaatcaccaactcagttagccataagttatgggaatgtttggttccaaacatgtcaacctgacacaggatcatacacagattcaaagtatcaacatgaaccttctgttacactgggagcacacctggccatgaatggaagctcagaacagtttcaggattacaatgtgtccacagagtaggtaggctcaaccagtgatcctctctcctgtcccagaatgtaacattgaagaagtgcacttggcattgggcccagcttgggttcctttacctgtggatgaaacttaatgagggaaacattaataacattattaacattaataacataattaaaacataatgaggggttggacagaagcaccaatgagaaccctgttgctcaaatctgccccttacaaaggtataaaatgtgtgttctttctttgttctgggtctctcctctggcctgcgtgctgagaggggagtccccaacatgttggatcaataaaaatccaataaggccacactcctaatagtgccactccctagcccaagcatatagaaatcatcacattccagtctctgaaccccagaggcttgctcaaacatatgggacataactaaacctaacataatgcaaagttcatttagtccaacttccaaagtcctcatagtctgtggcggtctcaacaatgttttaacttaatcttttaagaccaaagttcaaggtctctactgagatttactcaatcacttaactgtaatctccaaagcaagacaggaaaccaaatgggtaaactccaaactttggatcttcatgtctgatgtcaaaactctcttcagatctccaacctcttttttatctttgttgactgcaacaaacttctttctcttgggctggttccactccctgttagcagatttcctcagcagatagttcatggctctggcatctcaaacatcttggggtctccaaggaaaattcaatgttacagcttcttgtttcaatgtctgggatccacacataatcttctgggattctccaaagggctggtgtcacttctccagcactgccctcggtggcattctaagttcagagtgatccactccactgttgctgctgttcttggtgatcatcccatggtactgtgttgtgtctgctcttgaccagcaagaaagacacaacggccagattcttctcaacagcctttattgcaggaatgcctcaatgctgctacagggacctagggaacccagggaggtctgcttatatactctccagcacagggaaaggcttcatggccccctgggattggtcagtctgccggcacctaatttgcatgcacccgctccggaggggttggcgccagactcggacttacatctgcgctgatgttgtttatgacaatggcacacctggtgcccagagccatcttagagttggcttcctacagtactggtatctccaatactctggggccttctactgcaacgaggcttcaccaataacctctcataggttctctccatggtgccaagcctcaacttcttttcatgaccccttcagtcctgggctgtcaagtgcaactgaggctgcatcttcaccaatggccttccatggcctctcagagtgccaagcctcagctgctctttatgttcccttcatcccttcaaaaccagtaacacctgagtgatggggatggatgtagatgaggtgaaacccagaacacctctcattccctgcaagggaagacccatgcctgtagccagaaatgttaggattagagcaaaacccttagtagaaactgctgtgattctcatttggaagaccatggactgatctgtcagcagtgttattggaggtagcctttttctttctccattgtgaagttgatggtccttgggcagacttcaagaaagggtctgaggagacagacccaggaagagtgtagcaataacatttgatttgcgattaagaaggctggagtcataattagccctaaatgggacaactctatcaccctctccaatgctcagggaagaggagacagaaagaatgtaaaagccattctgggcttgacatagctgttgtcttcatgtggtgacctgcactagagctgcaggcgactgggcattcatcaagtgtgtgggagggtcccctgaggccccacccctcccttcaggactaacagaagttagtgcttgccaagggagtagctatcatcctctgcagtgacacggaagctgacaagttacccatgctccaggaaataaactcccacccacgctcaggcaggcgacttaccttagactgagtaagtcacacacaaaagaagacatgaaagaaggaggggctcttcgttgagactaagggtttcaagtgggagaaagagaaggataagactattaaaattcattacatacaggtatggaactgccaaagaagaaaatgatgaagagcagcagctgccgccaccgggagtgagtcagaggtggcctgcaagcctgcaggaacctggccctcaccaacagaaaaggcggaggacagacacctgacaagagtgttctcttccctccactaagtgtcttttacagtttacatgttgatttgggagactgttaattctgggatatgcggggggtggggtggggggaacaactccaacattctggaccaaatttaaagcaacctttattaaatattagatattgaccaagggatggaccttagttgggaccatttcacagaacttcccacctgagaatggcctgagccatgggttgcaggggcaaagggcaaacctataggccactgtactttcccatgatgctttgctgtttcctaagaactataattcccagcattgcaggaagttactgggtttctgggcaggtaaggcttacaggttaattttgggcattataagacaaataccaaaatattatctatgatactattgctttattttattttattttcaattacatatgcttgtatgtgcatgagagtgcaagtgcccacagaggttagaaggaggtattaggtatcctggagatggagttacaggagattatgagctatcatatagatgttggaattaaacctcagtcctctggaagagcagccaatgagccatatctccagccctatcaacctgttgggttgtttaaaaataattcttttatttttatttttaagtatgtgtgtgtttgtgtgtgtgtgtgtacatgggtgcagtaccctaagagaccggaagagaacattggattccccccccccccaccgcccccacctcccgagctggagttacaggcagatgtgtcccttggaaaccaaactcagctcgcctagaagaggactggactatcgagcctaagcgcccatctaagtctttgtatccagtctttctgcaaccctggaagcctttttaccaaaaagtacattctttcatcctagctgttttttgtgactagcacctgctgaaaaaaaaaaataagaaagaaagaaagaaagaaaaaacccaaaacatcatcaaaacaacaaaaagccaagcccaccaacaagaaacggatatacacaaaagccaagaaaaacaaaacaagcccccccaagccccagctattcatcaagataggaaagagaaacacccaactcctacctgcgcttggtgattgcttggtgaaaaataaaagtatttttcctctcattccttcttttgtgatcaaatgaataatgaagggattgagcctttgctagtgtgcatgcccctgcagggagccaagaaacaaataggtttcctaagggtataacccagccttttcggcttttccgtcatcacgtgattgagggcttctgcttcccacttaacctgcatccttcccagactgattcatggaacctcaagggctctacaggaaaattcaaacatcagcttctctctgccataggacttccatccgaaggaatggttccttggttgttgccttcacagccctcacatccgggctggacctggcagaaagttgacatttgacccctatctagagcatagacgatgctggcagccgtatgtcctcacttttgccattccggtgcctccctcggggcacagccaaggttccgagatgggcattttcaggaggaaacgattttatttgaggtcttggcagggagatgagaggaggaggcgtgccaccttctgtaacaaaaggcatttcccagccttagacacacccttaggcccagatgtacactcccactcctgtcaatccaactgcactgactagcaaccctaatgcctgctgcttccaggcaccccgcagcctgcgtcttgtttccactatttcctctgcctgtcgcagggaaagcctcactaccaagagccttcaaacacagttcctgttactaattttgccccaaagggtaccacagtgattaacttaatgcttccccagggatgactctctctgtctggggtcagggtggggctggatggattttctttattaaggatggtgggaaccctcttttgagctttgaagtctcgccttagatttttttttaattttattttttatttttgataactacaaagggacaggaagtctctttttactcctctgaggcttgctgttctccaggggcatggaaaatgtacacgttgttagccccccaagcctgggggctggggcccgcgctctgccggattgtttttatatcccagcaaaaagcatctgtgtgcagaacagcagctggtctgctgctgccaactgcacgttcccagtaccaatgtaagcactttccttagaggttaaaacccccaaggcactgtttgtgtttggagaagaaatgctctaaaaatagtaagtgggggtttaaagtctcttcgtcagatgttcggaagcacgctgacctggtgcgctgcttcttagaaccagagctcattggcaggttgctgtgccttgcacctacgattcctgactccttcagtaagctagctggtgaagagctggagaatctgtatttataataaatccccgggtggggcattgatgttgctgattttaagaacacacactgttgtagccagtcaaaagacccttactcagaaagaccacagagaccgccgccatcgctgcaaaccgcatgaggatttttattgatccaacatgttggggacacccctctcagcacgcaggccagaggagagacccagaacaaagaaagatcacattttttatacctttgtaaggggcagatttgagtaacagggttcttattggtgtagcaagtaaccctttcaggcattggttggtttgtatagtgactaagtaaccctatggcccagtgactactttgcttgcccccatggtgggttattatgatttggtcagcaaagtaatagtactttaacatcacagctattaacgtcaagggaattctcacaacaagctcagggtggtttgtggtctttgtcagaattcagtgtggggcaggggtcaggagaattgctaatcttgttatggttacttctctgagaacagctagtattgttttggtagttgcaagcttaatcattttgaccaccaaaactatgtttttacatttgtttagtcagccggcttccctatctggctctgcacgtggcctgcaagtacagtttggaaagtgtttttcgaaggaggaaggtactgggtggtcttgaattcattttggatattacaacacaaagaaccactggtctggtgtatttccccccagtctgttgttggctgcagggtgtaatacagacacagggtttattaccagggagaggagggtaccatagcttgatgcaattccttattacctgtgtcgccaagagcaagtagcttaaccttgctggtctctgtttcctcccttccttgacaatcatttctatagagctaatttatatcaggatcttaattatcttgttttgtggagggcacatgtttataaaacgttgatctttctccctaccaatattttttctcattgtcatttaaagagtcagttttgggactgacaagatggcttagtgggtagagaaggcttgccaccaaccctgatggtgggagctcaatctttgggactcacaaggaagaaggagaaaacagactctgatctgtacacatttaaattggcacgtgagcccttctcctcaaataaagtcacacacacacacacacacacacacacacacacacagagagagagagagagagagagagagagagagagagagagagagagagagagagagaaagatacacacacacatcccatacacattttttggccaggttagacaatgctggggaaagatatcagatttatgcatctctctctctctggactgagttggtgactgtgggaagggatgggacttgactactgcaacttgtcagagcacagtaggccactgtgaattgcagctctcagactcctggtaccatcccatagtccagcacatgggagctaaaagtccaaataacaacaatgctgtctgaggacttggaggcaggtgacattgtggtagggatttgtggatttcgatgtgtgtttgttctctgtttttaacaccttccatcagataagttcctgtcctgtttcttcagatcccaacctgttttccatttccttggggagcctttgaaatatgtggctggatctggatgttatgaacttgtatggagttctgcacaagtctttatagtttcatttgattgcaatccaattaatgtaaggatcctccctgaatgatgcgccctgtgaaagcaaactccatgcttaatctcttccctatacttgtgtagtatgcatttcttgacttttcatgagacattcagagactatcctataaaagtgtgtaagtcataaaagtgtgagattaaaaaaaatagcaggtgcaaatgaatcacattttcttgatccattctttgggaaacatctgggttgtttccagtttcttgctattacaaatatagctgctatgtacctggtagaacaagtatccctgtggtatggtggagcatcttttgggtacacgcccaggagcggtatagctgggtcttgaggtagaactattcccaattttttgagaaatcaccaagctgatttccagagtcgttgtactgttgtggccggccagcagctcgcaacgtgaacgtgactgagatggccactcgagctaagggaggaactagtcggggagaaagaagaaacggagccaagacaagttcatcctgttcaaagctcaattttactagttctgacattcagttataaaggaagggggagggaacccgattcccgccaactggtcttggagtccagtagcagggtgaacacgtgtgtggctccaagcagcaaagcagcacggtccagcagtgggcgtggcagaatgaatgagcgggaaactccacccctgagccagcaggttccaggctgggggtggggaggctgcagttgtacaagtttgcacctgcaatggaggaatgttctcttcgctccacatcctcaccagcatttgctaactcttgagtttttgatcttagccattctgatagatgtaaggtggaatctcagagtcattttatttgtattttccagatgattaaggacattgaacatttctttaaatgttcctctgacattaaagattcttctgttgagaattctctgtttagctctgtactctattttttaagattggattatttgttttcttggtgtttaagttcttgagttctttatttatcagtcctctgtcagatgtagggttgttgaaggtcttttcccatcatgtaggctgcctttttctcctattaattatgtcccttgcattatagaaggttttcagtgtcatgaggtccaatttattaactgttgatcttagcgcctgaaccatttgtgttctgttcagaaagttctcttctgtatcagtgcattcaaggctatccccactttctcttctattagttttagagtatccagttttatgctgaggtctttgatccacttgcacttgagttttgtgcaggatgataagtatggatctatttgcaatcttcctcatgcagacatccagtaggaccagcacaatttgttgaagatgctttcttttttccattgtatggatttggcttctttgtcaaaaatcaagtgtctatacatgtgtgagtttatttctctgtcttcgattcaattacattgctcagttattaaaagcaaggacatcatgaagttttcaggcaaatggatggaactagaaaatatcatcctgaatgaggtaacccagctccaaaattataagtagatattagccataagtatacatacaggatacccaagctataaaccagaaacccaattatgctaaataacaaggagggctcaagggaggatgcttaatctcactgagaaagtgtcctagtcagggtttctattcttgcacaaaacatcatgaccaagaaacaagttggggatgaaagggctttttcaagctacacctccacattgttgttcatcaccaaaggaagtcaggactggaactcacacagggcagaaacatggaggcaggagctgatatagatgccatgaaggggtgctgcttactggattgctcccctagcttgctcatcttcccttcttatagaagtcaggaccaccagcccagggatggcatcacccacaatgagccctcctcgcttgatcactaattgagaagatgccttacagctgggtctcatggaggtatttcttcctcaagggaggctcctttctctgtgataacttcagcttgtgtcaagttggcacataaaaccagccagtaaaggaggagaaacaaaatagtcattggaggggatggagggaaggaactggttgagagaggggctggggagggaaatggggagttggtcatcaggtgtagggagagaaggggaaagggggctgtgagagtgaatggaaatttgtggcaggtgggagtggggtgggggtggggaggctgccatatcatttctaggatgtgtcagagacctgggacaggggaggctccaggtagactatgaggggcctctagctgagattccttgtaatgggggatatggagtctgaaatggtcacttcctgtggccagacaggacctcccagtagagggaaaaggataccaacccacccacaaaacctttgaccctaaatttgtcctgcctacaagaagttccgggacaaagatggaacagagacaaagggaacgaccaaccaatgaccagcccaacttgagacccgtgccgtgggcaggaactaatccttaagatttaatgatactcttgttatgcttgcagacaagagcctggcatatctgtcctctgagaggctccacctagcagctgactgaaacagatgcagagactcatagccaaacattagacggaacttggaaaatgtggaagagttgagggaaagattgagggacacagagaggataggaactccacacgaacaacagagtcaactaacctggactcttgagagcttccagagactgaaccaccaaccgagcatgggctggaccttggcatcctgcatttatgtagcagatatgcaccttggtcttcatgagagtccctcaacaactagagcagggactgtccttgaccctgttaactgcctgcctgtggatcctattccaactgggctgtcttgtctggcctcagtggaagaggatgtgcctagtcctgcaatgatttgatgtgccagggtgggttggtacccagcacccccctcaaaggagaagaggatgagggaggagctatgtgatgggggtactgggaagagaggagagatgcaaattggaagtaaagtgaataaataaataaattaattaatggaaaaaagtagtgggtgctatgaaggagtcatctatattagattttctggagttataacaaaatacttgagagaaatggagttattttattatcgttttggagataaaagtccaaataacagtagtattatctgtggtaagaactactgtagatggcactgtgataagaatttgtcagttcctatgtctgtaaatgtgtagcgtgtgtgtgtgtgtgtgtgtgtgtgtgtgtgtgtctgcatgtgcatgtatgtggggtgtctatgtttgagatggatatggatgtgctgtgtgttatatgtatgtgtgatatatgtgctgtgtatgtggaagttatgtgtgggtatgggtgggggctatgtgtgaaagaaagagagaaacaggatagggaaaggaagtcagagccagacctatatggggacagtaatgacctccttatttagatttatctcttaagggttaaagatgacattattttttaacattgttgctccaggaccaggctcctaatgcatgcagtctgagagacacattcaaatcatatcctatacacagtaccatcctttggccagaatattggtaaaaccatccaaatgttagaggagagtagccaacagttctggcatccgtatacagcactgccggcgtagagtgccctactgccctgaagatgccctgtgatttcattgaaaattctttccagattggtaacctctcagcccggctctctgtgccttatagatcatgagatctgtaacatacaacgtaacaattagcttctcagttcttgttggagaggctgggtttataagaaagaaagcagccaagcacatcagcccacgggagcctggcataaagtgtacctcagcagttccttagtgtttgtagaataaagtaatgtattatagctttcctatagatccacatggaagcctgagaagctatgtggttctcctcagacctcatagtctgctcagattcactcacttgggcgggttgtatagctctggggaagatttcacttctctgcctcagcaacacaggctcaggcgcatcctgctttgggttgtgaagttgaccggaagtgacacgtatagctttcagaaagaagtttgaagagccagcatgtgactgaccattcgtgcccttataccttgttttttccaaggattatgatagagccacaggccattgggtgctgatatttgttttcatggtgtaactaaatctgtccgcagagcaacacttcttttttatgaagataagaagtaactgaggcaggtttccaatctagacatggttactgtagggtctgctacttgctagcttcacccagctgaatcaagaagagaaaacaactggccaagcttgttgggggcatacatgaaagtctagtacttaggaggtggaggcaggaagataaggagtggaaggtcagtcttgggtgcatttgtgtgtgtgtgtgtgtgtgtgtgtgtgagagagagagagagagagagagagagacagagacagagacagagacagagacacagagagagacagagagagacacagagagagagagacagagagacacagagagagagagacagagagagagacacacacacacacacacagagagagagagagagagagagagagagagagagagagagagagatattccctggaatcaggctcccattacaagcactaacaattccatctgatgccttgcaaattgtttcagaggcctgggaaagataggaaaattttctgcctatttttagaaagccaatgtaacattgtaccaaaatcttataaagatagcattgaaaaaaaagaaaaccaacatccgatctcattgaaggagtaacaaatcctaaattattaaaataataacagttcagcaaagcattaaaatataccaagtgaagtccccttttgacaatcaacaacggcaccttaccccacacacattatgactgactgtgtacccctctaaaataggacgaagggggaaagaatgcattgcttcagaaaatgacccagcaacatatgctagttatctatttatttttcttgccttgacagaagctagctagtattatctggaagcagggaacaatgtctgttgagaacctgcctctgtccggattgaactgtcacaaggcaagtctgtgaaggcattttcttggtttaataattgatgtggtaggtccagccctctgtaggtggtaccacactgagtgtgtggtcctgggtcgcagggttaaggaacctgaacatgagcctggagaggaagccaggaagcagcactccttcatggcctctgctccacttcctgctttgagtttctagcttgaattctcttcatgaaaaattattggctgggctggcgagatggctcagtgggtgagaacactgactgctcttccaaaggtcctgagttcaaatcccagcaaccacatggcggctcacaatcatatgtaatgagattggacacgctcttctggtgtgtctgaagacagcagcagcatacttatttatactaataaataagtctttgggccggagcgagcagaggtcctaaattcaattctcaacaccagatgaaggcttacaactaactatctgtacagctacagtgtgtaatcatatacataaaataaataaataaatcttttaaaaattgaaaaattatttggtgtaaggtaaagaaacaaaaacccaaacaccctttccttttcaagtcgcttttagtcgtggtgtttatcacaggagctggaggccatgtaagatgcgtaggatgtagcatttagaagccatgtaggacacctcgtttagtggagctaagccactagtgtgatataagagtccgacgttaatagacggctttaccaaggaataatgaattctgtatttcaaacggagtcgggattggcttagggttaaaaagaacctagaagtcaaggttccccaggctggggtggctctgatagacgagtgccaagcacagctgcagatagcgcaaaagtatgacttaaaagatacatgctataaggaagaaaagtgagggaaaattgcaaaatatgaaaatagcaagaaatttcatgtatgtatcaagtttcccaaacaagggacaggcacacagtcacacagacacatagacacatagacacacaggcacacagacacacagacaggataggatattaagcactgcattttgttcctcttgttgaaaccctatgtagtttcattatgtaatccaggctgtcctccgactcatgctactccggactcagtttcccaagtgctggggtttcaggcacactgctaccttgtcccactgaaagagttgtgcctgagatggtcattacttagtgaaggacagtgagacttcagcaatggagatggcatccttgttagtggatttgtccacttaaatgcattagacaaagtctggcttatcatttattattattgttattattattattattattattattattattattattattttaagcatagagttagtgattactcattcctatactttcctattgttaaggaaaaaaatctaaaatggcaaaatcacaatgtgaaatacatatgcaaagatcttaaaaccaccagtccgtgagtaaaccagttccttttggagacaaaggaataggcagtaaataagagaaaaccacatttgttaatggatgggtagttgttcactctagccatggagacactgaatcagcactcgacacgattcctttacatacttacagaggacattgattcgtttctattgttactgagtagctccaacttcccaggtcacaagttgccaagagcagccaattattcttaagtttcaatttgttgaaaaaaaaaaaagccctgatagcattgatgttcatccccgagcaactcagtaactcagtgtgtgtgtgtgtgtgtgggggggggtgtgtgtgtgtgggagggtatgtctgtctgtgtgtctgtgtgcatatgtggacatacatatgccatgtcacatatgtggaaatcagaggacaacctgcaggagttagttctgttcttgaaccatgtggggttctgggaattcgagtcaagccattaggtttggtgtcaagagctttttcccgttgagccattttagcccatagaaactggttctaccacaaacatttacaagatacaaaagctaaggacactgcttagtccatttaaaatgatataggtcccaaagcttcgcttactgtgggattttctcctatcatctcatccctttctttcatctggtctttaggatccttttctgaaggtgtgaagttggtagagaagcctactgtgtggacaggaatgtctctcaaatgcatcaccattttgagtagtagtgattgagaacaaagggaattgttgtaaggtgtggagttatttgataaggtgtggttgtaacaaagcaccaaaactgggccagggagatagcttatcaggaaaagcacttggtacagcctcctgaatgccagagttggatccctggagtccacagaaaaagccgagtgtggaaagccagatgcagtgacaggaatttgtaacttgggcattcctgggaagagatgaaaggagaagatgggagaatggcctgaagcttaagggacagctatgggatgtgtgctacaagaacagaaactagggagactctgcctcaaagtggggtgggaaccaactacacacaggtatgttcaagcagacaccacacacacacacacacacacacacacacacacacacacacacacacacacacacacacattattaaagctgataacagcttttagactaagtagaaggaaaaagagataactgtagttaacaaaatctaattcccaatttgctacctacattccctacctgcagtatgctaactttaagagggaaaaagtcctccaaccagagtgtatataaaatatgttgtctgatcctcccaatagtggttttctaaaaggaatatcatagaagatatttagaagacttccttttacgttactttttgagacagggttttatgtaagccaagttgacctcaaactttgaatcccacttctctacttcctgagagctacagctataaatatgcaccatcatggctggtttacatggtgctggggacagaacccaggactttgtgatgctaggcaagttctctaccaactgaggtcgatccccagccctcagataacattgtgtggcgctattctgtctacccaagagagtttatagtttagacttccagatcaagcgaaataaagagttctggggagatgtccttttgcttcctagtgtaggtatagatgttacgggatggcaggatttagtcagaggaagagactcaacttctctgaaggtcttactatgcatacaactttctgctatggttcttatcctgtggcataaggacatcccctgccacccaattttacatgccacatcccaaatcattgtaacgaggcttcacatggcaaccagcagttgactgcaatgagacttccatggcaaccagcagttgactgtaacaaggcttccatggcaaccagtagttgactgcaacaaggcttccatggcaaccagcagttgacacctgccttgctctggttttgttacagctgaactgtttctcatctgtgaaacccctttttaaaacatgtattcatttatcttatatgtgtacactgtagttatcttcagacacaccagaagaggacatcagatcccattacagatggctgtgagccaccatgtggttgctgggaattgaactcagaacctctggaagagcagccagtgctcttaactgttgagtcatctctctggcacccccgctcccatgaaacccttttgcatatatctttttgtcttctagtcttgtggtccacaagccctacaagtcacttttggagttcttccttagccccactcccacattcttgctttggattatcttcgacattcagtgctctcagggcagctgtgaacctccttgaaaaattttctctcttgtctggtctctaatgatgtgtagacttgacttactaggggttcatgtcttgctctctctttcatgcagttcaattcatatttagcatcctaagtcagtgactatagggaaaggttttgagcccccttggaagtctctgctgcaagcatagatcttgcagagtagatatttaatgaactcttattaaatccatgcatgaatgaaactcttcatgtgtatttcccaatcttctctctacatcattgaaaggggaataacagaatttaaattcttcacaattcctgcaaagggagacttctactaagtatgaaatgtgcaaggcttgaatttgtaatgaatgtctgatgtaacccagcattcccagaatcaccacttgggttttccacaagggtatgcattcctcttttatacaaatgcatggagggggaggggttacaggataggcagaaatgaaagatatttgttaattttctgttattgtgataaaacactatgatcaaggaaactaatcgaagaaaaaagtttatgtggggttatggtggccgaggattagagtccatagcttgcaatggaggttgcaggtaaccagaacagaacaggctcacatccctgtcttcaagcaggaaacagaaagcatgcggagtggtgtaaggcattaaacctcaaaggccatcccacaggtcacacttcctatacctccccaaacagtgccaccaattgggaaccaaacatcagagtctgtggaggacatattcgttcaaaccaccaccacagacaagtagtttattctgtgcacccttcttatggaggaggctgacaagtaccactgtttacacacagtaggactgccacgaacaatatagccatactcactacctgctttcccggtttgtggccttcccatacctcacagaactttcttcttcctgcctgtacatttcactgctgtctcttgctgtggagtggggctctatatgtgcgagggtctcagtgtgaagcaggctctgtgctacttgtcttatcctgagttacagagattattttttgtcccagtccctatcaggagtcactattttgagcccaatctggtagctctggtttcttctttccagaatattctgagtcgcgcagcctcaaaccggctctgcctttcctctacatgcctgtgatgacgactgcctggctgcagatgctccgggtgttttcccacaccagtttctcttgttgtgactccatcaaacccaggtcagcttctgtaatcgagacgatccacttaattaactgtaatgaggctcccatcatttccaataaatttctttccaaaacaccacttgagaggcacatagcttcctatcagctgtaaattttttttttcctgtctatttagttccaggaattgaatttactcagagatgtcattgcccaacctcatgtctcaatgttttaaactaaatctttcagtctggtgctatgggctacaggacccaaccccagtttcccttgtacagaatggaagatgccgtgcaaacagcttgtctgggtttcaccagagctgggagaatcagtgctggttttcatggcctcttctgcgatcagccccttctccaccaacagttttgttagttagacagagcaacttgcgcttgaagatctcaaaccatttatcgaagcatgccatcttctcctttttaaagacctgaaatgctgttggaataattttgctgtgttttataaaaatatagagaggattaatacgtttggtagaggtgcaataaggtgtggagggaaggggtgcctccaaaggcctgtgctgaggcacctcttccccctgagcgaccagccaaagaatggtatagtatagaatagagtttattcatggcatggggaggggagttgagagagtagtagagacagagaaagagagagggagagagagaaagagagagagaggggggggagggagggaggaagggagagagagagagagagagagagggagggagagagagagagaagagtagtagaggctggtcatgagcatgtggagagagagggggaggggaatggggaatgggggagcaggagggagaggacagagtcggagcaagaaagcaagagagaacagaggggctaagcagtcccccttttttcattttaaaaattttattagatattttctttttttacatttcaaatgcttcctataccctcccctcgccctgctcccctacccacccatagcagccccttttatagtgagtcaggcacacctggctgttgccaggtaactggggcagagcctatacaaaaatgctaacagatttgtcagtgaaatgatattttgctctttgacttatagaagatgaaaaagaaaaccacaagtttcatactgaccctttggggaggatacatctttaagaaattatgggagagaatagtttcatttagaaagaatttaagtgtttttttttcccctctcagacatgtcatggtttaatatcagttatccaatttttctttgtgctactctcagaattcttcctgagaaattagctttaatcttctgctttgtttcaaagcctgcactagattaagcctcgtcctctctctctctcctctctctttctctttggcttcattcgggaatgactaattagccaggagaaattaaatttacaaattaaacctctctgcatagattttctcaagaccccagccctgggggtaatatccatggcctctcctacagagcttttgcctcccagagggttgtatagaggggtgaaatgtttatgaagccacatcggcttgaagagcaggttggtggttggcggttggcagcattataagttgttctttggttccttcagggaaaaacttcagtgttccaaagttcagggtcatggaaggagggtgaggaatgttcccagccagagaagaaagtgatgtgtgtgagagagaactgccgagaactgtagaactgaagtttccaccgctccaattacatgcctgaatgccttcttttcatttcatctctgtttattatctttgtctgtgtgtggatggtgtatatatggtatgtgcatttatgtgtgtgagtgtacacttatgcatataaattcaagtgctcatgttttactccacgtataaagagatcagaggacagccttgggtattgttcattgcctttcacctttctctttctctctcttgaatacaccacctatcattgtaggagactggcatcacagacctgccatggctggctttgtatgggatgcagggatgtgaatccaggtcctgatgtctatgtggcatagacacttaactaggaccccaacccattcacctcccaagcctgactctgctcccctgctccactctacaacatgccctctactcgataaaggcactaaaatgtgtgactaggggccatccagtttgttctgagtgtcagctcatgcctccttcttaggaagcatttcaagccaatgtctcttaataccacccacggttcattgttttctggcttctccttccttccttccttccttccttccttccttccttccttccttccttccttccttcctcccttcctcccttcctcccttcctcccttcctcccttcctcccttcctccctttctcccttccttgctttttctttctaacatcttttgtgtattgaaaatgctgatgtttttgctatttggggatgagctcttgcaggatagtgttccccaactcttctcttccaagtttattctccagatctttgcattaagttaggcaggctcctttagggacagagaccgacggcttactggaggggaaggcttcagtcccattaaaagatggttaatgaacattcaaagttagtgtttctctttgtttcagctgcagatcttttggagaatcttaggagaaagcagccaagaccactgaatccacctgacctcattaacctggagcaaactgggcttattagaatttagattgaaggcctcagaggttagatattgctcttggagaagacctaggttcagttcctagcacccacataggtcggattacaattgctgataactccagttccaggggatctgtcactttcttctgaccttccaggtcttcatgcacattgtgcacatacagacaagcacacgcacacacacacacacacacacacacacacacacacacacacacaaatattaaaactctggagtgtgaacttagtatgcccataggtaattatgtccattagctttcctcattggacattttctctgtcacctttaactcaggatgctcacaaatatccctacccctctacgtacttcctttatgaatttgtatatgccccttcccttgtttggggagcagatgtttctctactctttgatctgactgttgtgctcactggtttcatactcaccaagagacctgattcgacttaggtaccgagtcacccacgtctctcagggtcagcctgctctgtctctcagtttttggtctaagaaaacaaggccttccacccttttgatcagcagatatgagtaaaagaaataaaagttgatgctctttgttttccagggattcagataaaatgtttgccatatgcatgaaataatttttaagaggtaggttggttcttccccctaaagcaaggtttatctaagaagagtgcttttaaggatggtcgtgatgctgacagtacctcgcattcctaccgtcatttctggaaaagccattttaatttttcatctcacctcgccatctgggagacaagtgaactcaatgttttccttgccatttataaagtgagttagttaagactcgggtaagactattgatctgcaccaagatccaataccaggaaaagagatgaaattggtatccaaacttttgtttcaggactctgagccctggcctctattgtctcaaacacagttcaatcataaactgagtcaatacatctagcactgcctggcagtataaggcaattaaactatcacaaggctatgggggtaaagacactatcacaaaggtctgggataaataaacttgaacaggttgataaagtgtgggactcaatctctaaaggaggtgctgtaatctctctgtagtggaaggtttacctgaaggaacagatttgaagttattcctgaaagcatactaaaaccagaagacagtttggcagtccgaatcaaaaactttaactaaagacatgaaccacagtactttccagcatatcactcagtggctctaaagttcttttccttgtttgaaaacaatagagtccaggggaggattaaatggtgatttgtaaagtgccaggctcagggcacattcagtaaatgttaccagtgattgcagaataatggtgataatattttcctttgtaggaggaaataatgagcacgtagatttagcaacacacagatcgtttgttgtgcttttaaaagtcacagtgaaaagttggaaacaacttgatgtccagcaagagggaattgcagaagagagtttcctggtatttctaggtgctagatcattagatagccatgtaaaagaataaaaggaaataaatatgttattgcctagcaagatggccatgaatttgttgttgttgttgttattaagacagggtttctctctgtagccctggctgacctagatctatagaccaggctggcctcaaactcaaagatcgatctgcatctgcctcctgagtgctggggttaaaggcttccaccactgctgcctggctataaatgtttaaaatatattttctattaattcttcacaaattccatatatgtgtacagtgtattttgaccatattcacccctactcctcttcccaacccctttcagctcccctgctgccatatttccatcccttaccaattttgtgtactatttaattaatagatatatacatatatatatttaattctgatatatcagcacattatatattatattatattatatgttacatatattatctgttacataatatacatgtatacatgtatgtatatatatatatatatatatatatatatatatatatatatatatatacatattgatgtacacccattcattggagtctggatgccttgccagggaccactcttaagcaaagtggcctctccctgatctggaagtcccttgactgttaacagatccttagctagggctggagacttgggagccccatgcctctctaagcaggaatcctgacttggtcttgggctgccactgtgagctcatgaggcagtgttgggggagggatgctttataccatcccctttgtgactgagaattccacaaatgctcattctctgcacttggcagtgattttttacctttcaaaaacacttataaaatattaaatcctttttttttaagtttgtgcttttttgatgttgtttaacacatatattcatgtacagatacaggatagctttaaaaactaggagatgaatttgcagctctatgtcaacaaaactgacatttaaaaattgtttttattaaaattctttttatttaaactatcccagtaacaaaggcaagtatcatgtaaaataaaattgtgctgttttgttttgtttctggctttcttgtttcctactctttcctttggtttgtcagctctgtgctaccataagcagacacgatccattcaatagttgactaacagcattcttttgagtgtttactgtggccaaggccctggttctaagcacttgatgtacagataaaccagatgaacaacaatgcccttcaaaagcttaaattcaaggctggagaaatggctcagtggttaagagcactgtctgctcttccagaggacccaggtttgactcccagctcccacatggcagcttataaccatctacagctccagtcctgggaggtctgacactctggtacccacgtggtacatataaatatatgcaagcgagacatgtgcacatataattgaaatataggtatagtgatcttgggattccagtgtctgaagcaggagaaggatgagactgagatcagcctggaataagatcctcttttgattaaaacaaaagcatgtactaggtgacatgaacagcacaaccgcaagagaaggagagtagaccaaaatttctagaggagctatgccttcttaacagcattcaacccctcttctgagaatccctgcagactgccctccagcatcactgatttccatagaggctgcatagctgtcaaagttcacagtctactcagaggtaacctgctgtgtcaatatttgtaatttgtacttcatggtgagtcacttccagagaatagattatctaccatggaagggaaaaggtctgggagtgaaagtgagctggacaagacacaggtggaggcattaggtttcaacagcttcctgcctctacaaagcaaagggcaggaatgtgtgctggcgtgggctggagcccagaacagccacaactctcaagtggaggataagcagaaagcagggttagtctcctgtttctccaggtggttctagctgattcttctaggtctggaaacaaatgttaccttctatccattttctctccttctcccctggcttccatttttatagctcagaagcaaatccatcttttaagagttgttctcaagcaatctttgtctaaagctggatcctcaccatactacatcccacttcacccccacctccaccctcactgccaattgaggaagttctctgaattctgacacctccatagcatgtgatagtcccctatgttattcctatgcatcaattcatttttacattgtgctggagaactccatctctcttacaagagtagatgatcattaaggtttggtctatagaactccaaatagactggactagaaaagaaattccttctgacacataataatcagaacaacaaatgcactaaataaagacagaatattgaaagcagtaagggaaaaaggtcaagtaacatataaaggcaggcctattagaattacaccagacttctcaccagagactatgaaagccagaagatcctggacagatgttatgcagaccctaagagaacccaggccaggctactatacccagccaaactctcaattaccatagatggagaaaccaaagtattccatgataaagccaaattcacacaatatctttccacaaatcgagcccttcaaaggataataaagggaaaacaccaacacaaggacagaaactacaccctagaaaaagcaagaaaataatctttcaacaaacctaaaagaagactgcagcaagaacagaatccaaactttaacaacaaaattaacaggaagcaacaattacttttctttgatttctcttaacaccagtggactcaattgcccaatgaaaagacatagactaatagactggctacacaaacaggacccaacattttgctgcttacaggaaacccacctcagggaaaaagacagacactacctcagagtgaaaggctggaaaacaattttccaagcaaatggtctgaagaaacaagctggagtagccattctaatatcgaataaaatcgacttccaacccaaagttatcaaaaaagacaaggaggggcacttcatactcatcaaatataaaatctactaaggtaaattctcaattcttaatatctatgctccaaatataagggcagccacattcattaaagaaactttagtaaagctcaaagcacacattgcacctcacacaataatagtgggagacttcaacacctcactctcaccaatggacagatcctggaaacagaaactaaacagagacacatggacactaacagaagttataaaacaaatggatctaatagatatctacagaacatcttatcctaaaaaaaaggatataccttcttctcagcacctcatggtaccttctccaaaattgaccatataattggtcacaaaacaggcctccatagatacaaaaatattgaaattatctcatgcatcctacctgatcaccacggactaaggctgatcttcaataacagcataaataatagaaagccaacattcacgtggaaactgaacaagactctactcaatgattccttggtcatagatgaaataaagaaagaaattaaaaactttttagagtttaatgaaaatgaagccacaacatacccaaacttacgggacacaatgaaggcagtcctaagaggaaaactcatagccccaagtgcctccaaaaagaaactagagagagcatacactagcagcctgcagcacacctagaagctctagaactaaaggaagcaaattcacccaagaggagtagatggcaggaaataatcaaactcagggctgaaatcaaccaagtggaaacaaaaagaactattcaaagaatcaaccaaaccagaagctggttctttaagaaaatcaacaagatagataaacccttagccagtctaactagagggcacttgtatccagtctaactagagggacagtatcctacttaacaaaatcaaaaatgaaaaaggagacaacaacagatcctgaggaaatccaaaacatcatcagatcctaccacaaaagtctatactcaacaaaactagaaaacctggatgaaatggacatcttcctaggcagataccaggtaccaaagttaaatcaggattagattaacgatctaaacagtcccatttctcctaaagaaatagaagcagtcattaataggctcccaaccaaaaaaaaaaaaaaaaaaaaccaggaccagatgggtttagtgcagagttctatcagaccttcaaagaagatctaattccaactctcctcaaactattccacaaaatagaaacagaaggtactctaccaaattcattctatgaagccacaattactcttatacctaaaccacacaaagatccaacaaagaaagagagcttcagaccaacttcccttatgaatatccatgcaaaaatactcaataaaatccttgcaaaccgaatctaagaacatatcacaatgatcatccatcatgatcaagtaggcttcatcccagggatgcagggatggcttaatatacggaaatccatcaacataatccactatataagcaaactcaaagacaaaaaccacatgatcatcttgttagatgctgagaaagcatttggcaaaatccaacaccccttcatgataaaagtcttagaaagatcaggaatttgaggcccatacctaaacataataaaagcaatatacagcaaaccagtagccaacctcaaactaaatggggagaaactcaaagcaatcccactaaaatcagggactagacaaggctgcccactttctccgtacttattcaatatagtacttgaagtcctagccagagcaattagacaacaaaaggagatcaaggggatacaatttggaaaggaagaagtcaaaataatcactatttgcagatgatatgatagtgtatatataagtgatcttataaattccaccagagaactcctaaacctgataaacaccttcagtgcagtagctggatataaaattaactcaaacaaatcaatggcctttctctacacaaaggataaaagggctgagaaagaaattagggcaacaacacccatcacaataggcacaaataatataaaataccttggtgtgactctaactaaggaagtgaaatatctgtatgataagaacttcaagtctctgaagaaataaattgaagaagatctgagaggatggaaagatcttccatgcaggattaattggcaggattaatatagtcaaaatggctattctgccaaaagcaatctatagattcaatgcaatccccataaaaattccaacataattcttcacttagttagaaagggcaatttgcaaattcatctggaataataaaaaacataggatagtaaaatctattctcaacaataaaacaacctctggtggaatcaccatacctgaccttaagctgtactacagagcaattgtgatgaaaactgcctggtactggtacaatgacagataggtagatcaatggaatagaattgaaggcccagcaatgaatccacacagctgtggtcactggatctttgacaaaggagctaaaaccatccagtggaaaaaaggcagcattttcaacaaatggtgctggcacaattggcggttaccatgtagaagaatgggaattgatccattctttttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcggcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctctaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattttcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacagttgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagagagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatacttcttcttgtttccacttggttgatttcacccctgagtttgattatttcctgccgtctactcctcttgggtaaatttgcttcctttttttctagggcttttagatgtgttgtcaaggtgctagtatgtgctgtctctcgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtcgatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcccgtgtggacccttgcgggtgttgggcaagactctgctggcaaggtagcccggggctcgagtctcgagtcgagcagaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgagtcgagcggcgaattgatccattcttatctccttgtacaaagctcaaaagtaagtggattaaagacctccatataaaagcagagacactgaaatttatagaggagaaagtggggaaaagcctcgaagatatgggcacaggggaaaaattcctaaacagaacagcaatggcttgtgctgtaagatcaagaattggaaaatggaacctcacaaaattgcatagcttctgtaaggcaaaagacaccgtcaataagacaaaaaggccaccaactgattgggaaaggatttttaccaatcctaaatctgatatgggactaatatccaatatatacaaagagctcaagaagttagactcccgaaattcaaataatcccattaaaaacggggtacagagctaaacaaagaattctcaagtgaggaataccaaagggctgagaagcacctgaaaaaatgttcaacatccttaatcatcagggaaatgcaaatcaaaacaaccttgagattccacctcacaccagtcagaatggctaagatcaaaaattcaggtgacagtagatgctggcgaggacgtggagaaagaggaataatcctccattgctggtaggattgcaagcttgtacaaccactctggaagtcagtcttgtggtttctcagaaaattggacatagtactgctggaagatccagcaatacctctcctgggtatatacccagaagatgttccaactggtaataaggacacatgctccactattttcatagcagtgttatttataatagccagaagctggaaagaacccagatgtccctcaacagaggaatggataaagaaaatgtggtacatttattcaatggagtactactcagctatttaaaacaatgaatttatgaaattcttgggcaaatggatggatctggaggatatcatccttagtgaggtaacccaatcacaaaagatttcaccagatatgcactcagataagtggatattaacctagaaacttagaatacccaagatacaacttccaaaacacaagaaaatcaagaagaaggaagaccaatatgtggatacttagaataaggaacaaaatagccatgaaaggagttatagagatgaagtttagagttaagacaaaagggtggactatccagagactaccccatcttgggatccatcagccactaaacccagatactattgcatatgccagcaagattttgctgaagggaccctgatatagctgtctcatatgaggctctgccagtgcctggcaaatacagaagtggatactcacagtcatctattggatggaacacagggcctccaatggaggagctagagaaagtacccaaggagctgaagggatctgcaaccctatagatggaacaagaatatgaactaaccagtacccccagaggtcatatctctagctgcatatgtagcagaagatggcctagtcggccatcagtgggaagagaggcccctaggtcttgcaaactttatatgccccagtacaggggaacgccagagtcaagaagtgggagtgggtgggtaggggatcagggtcgggagagggtatagggaactttcgggatagcatttgaaatgtaaataaagaaaacatctaataaaatagcaataaagaataaccactacaaagagagaaaaggacaacaaaagcctgcagtaagtttgctagctgaacagagcagatgaataaccggcagcagactttgcaccacatcatttcctttggccatccgcacagattgccggaacaggcaaaccagatctccatgcattctgttgtccccaccctctgggccataggacttggacaaaggtaatgtcctggatctgaaagaagttaagacactgggatggtatttaattaaataataacagaggctcaactcggtgattggcctggctggaccagcctgatgtgttgataattgtctaatcctctagtggatatcaaaaaaaatcattgctttcccaagggaaggggacagccaggagaaggagaggtatacatggatgataaacgttccagatactggctaagtgcttaccagtaaattgaagtccacatttcacagcatactccaggaagtcatttctccccagccagactcaacagtctttgaaggcttctaaagtccagctgggaggtagtgttgagcctctagcatgtctattcatagactactagatcccatgagagctgccattacaattgctggagtacattttttcacttcctatcacctaaataaacttcacccactgtgtgggtttgctaatcccttcctcatccttgctgtatccaccaccctgtcttgtttccttagcaactagacactgctgagggcagggcagaaggctaaaagggagcaccagtaagtggaatgagtgagtggtggcttggtgggctgcagaggggttagttctcacgttgcctttttgagtattccccatcattttctcttctagtgcgcaagtgcagggtcctcacatctatccacactgtccacacagagagaacacatttttaaaagctagcccaaagagagaacaaagagctgaggataactattcctaacccaggatgtctgccttacattactttttaggtactttgcatttgtttgctgctactatcattgtttgtttactatattttaggagttcgaacaatcccaggcaccattcagacagaaagtggcaaatgtcatctaaaagggcagggcttaacattcccgtggcagtgtgtgcttccccagtcagagagagcactttcttgcttttactgttttctaactcgagatttcccccgcttttctggagcttttttttttttgttgtttagcttctcatcaagaaagtataagttgtaggctgcgggagtgtctgtggggatgcgtttgttttgtttttgagacagagtttggctatttagagaaggctagctttgaactcccagagacccacctgcttgtctcaagtgctggcactgaaagtatgtgtccacatacctggcctcgtgtactaattttttgataattacaaaaaagggcaagaaaaaaagaaagaaagaaaatttctttcttcagccattcattctgtagcctgttgtgtccaacactgatctaggcattcttttggggtacttgagcagaaagactagactgtgtactttctagctgggctcttcaccagcaggtgcacatttcagtatttatttggccacttgaaaatctcactgttgattttgtgataaaaaaaaaaaacaaaacccaggaacttatttgtaaaacgattattcctggtgtttatctgactcaccttatcatctgtgtttaaagattggtggggtacactctgagctatttgtacttggcaagatccccaactctgagagcaaggttttagctggctagttttcctccttcagcctctgccaagtgcttggtcctctagagaataatatgtaccttttgtccccacatattaaatacaaataaagagaagaacatgtcatcttgaggcattggaagctattaaggctatctcaggcaatctggacaactctacgccttggtcacatagtggcttcttaatatgtaccatggctcactcaagaaaaatggagtggtgaccaacttcagcctctgagttttgagatggagactctgagatagctgtcaatattttgtaaaactgcttcctaacatcccgtacccctttctgtatgtatatctgcatgcacatgcacacatatgggtatagagcccgcactggccaaaagatgagagcagatctccctggatccagaattatatatggttgtgagcttccctatattgctgctgagagccaatccagttctctggaagagcaatactcactctcaactgctcagtcgcctctacaaaccaactgttttttgtttgtttgtttgtttgtttgtttgtctgtttggtttggtttggtttctcttagacagggtctctgactgggaccgaggcttgctgagtagggtaggctatttgaccagcagccctcaggaatgcaagtattttcctcaacatctgatttcctctttcctttctccctccctccctccctccctccctccctccctccctccctcccttccttaatttcttcctttcttctttctttcttcctccttccccctctcttcccctctctctctttctttttttccattgccgacatgaagaagtagagatgagcatgaccaaggtcagtttctgcttttcctgtgacaagggttctccccagtcaaccctggtctgcccacagaattcttatcccactgaaaggaatagacatttccctacatgaagagttgtaaagtggtggttggtcccattgcatgcacagagagtgagagacgggtaacctgtgagacacctcctacataaaaagagttccagtgatcttcaaagtgtttgtcactcacccagaaaaactccagctcctcactaccaagcctaggaaaggaagacagaaatacctagagaggaattccaatcacctcaagaaaaatggagtagtgaccagcttcagcctctgagttttgagatggagactctgagagagctgtcaatattttgtaaaaccgtttcccactcgatagcattcccagagtgaaggtttttctctcctcagccatgagctaggcttctggatttctacatcctgtttcatttgtgttcttcctcctatatttaagtgtaagcttgaatgagcgtctcagttcacttcccacaatacgagaatttcccaaacaaggagggcacaccaaactcatgttagcagtgcctcttcaggtgttgcccatttttctccttcaaaagtccccaagcctcccaggtactactttgccagttcaggttgttcaggggaggtacaccaagtgctgattcccactgagctcctactgaccctattcagtattgtgccacagtttacccttctcttctcttctcttctcttctcttctcttctcttctcttctcttctcttctcttctcttctcttctcttctcttctcttctctcctctcctctcctctcctctcctctcctctcctctcctctcctctcctctcctctcctctcctctcctctcctctcctctcctttcccctcccctcccctccccctcccctcccctcccctccccctcccctcccctcccctcccctcccctcccctcccctcccctcccctcccctcccctccttttcttttcttttcttttcttttcttttcttttcttttcttttcttttcttttcttttcttttcttttcttttctttgtgataggcttgggaagcttcccctgcaggactgtggagctcttgtgttcacatttgtgccttttggaaagatgcttcagcggctggacccgaggcaagagtttgtcttcaaaatgctgccattgcctctgtcagttttcatctgcctgtaaactttttttttttctttttgccaaatctcctgaagcaacttgacctcaaggttttttttttttaattccctcaactctttctttattctttgttccattttcactatcttttttttcttattagttaagagaaaccaaagaattgattcacctgctcattagttttctcgaatattcccctgtgactaaagtaaaactaggctacacccctaagagaaagatgcctcttagggctcctgtcatcttcctattgtcttgactggtgtgcatacaaagtttgaactatgaaactagggcatggctgattttggctccagtgtttacttgtgaaccagtctattcactattgacctagctttcagattccacagcccttctagcttccctaacataaaaacataagcattatatgtatttaggaagtatcatgttgtgttccaataatatttatgcagtttgacctcagttgtgcccttaatccttgtagtacctgttttagttagggttttactgctgtgaacaggcaccatgaccaagtcaactcataaaaacaacatttagtttgagctggcttataaattcagaggttcccaccaatgtcatcaaggtgggaacacgatagtgttcaggccgatatggtgcaagaggagctgagagttgtacattatcataggaaggctgctagcagaatagtgacttccgggcagctaggatgaagatcttaaagcccacacccacaagagcacacctactccaacaggaccacaccttctaatagtgccactccctgggccaagcatattcaaagcatcacagtatcttaattagaaaagtgggagctatcccttgttcatctgtcttagttgtcttgactgctataacaaaacacctcaaactcattcattcacaaag

SEQ ID NO: 5 - DNA, 171477 bp, Artificial
  Synthetic
ggtgttccttggcaactcactttttctttttaaaaattgtgtgtgtgtgctgtgtgtgtatgtgtgagtgggtaagtaggtgtacagcagccaggggaggatctcagatgtcttcccctatcattctgccttgtgccttgtgcctttgaggcagaacatcttggtgaacccagagcttatatatgtagacacacacacagatatataaacacattatatgtatataaatatatataatgtgataccataatatagatatatacacaagacacacacacatatatatgtaatataatatatgtaatttatatacacatatgtatatgaatatatatatataatatgctaccataatatagacatatactagacacacatatatgtaatatatacaaatatgtatataaatatataatttatgctatcataatatatataccctagacatatatgtataatataacacatatatgtgatatatgtgtgtgtgtgtatatacatatatatatatatatcacgcacacacacatacatacgtctagggtagcaaccaatcctagtaatcctcctgttttcattcccctcaatggtctacaggcatgtatgagaccacatatggcttttatgggtgtatgtgtgatctaaactcagaccttcacgtttgcataataatcactgttaactgctgagccatctctccttctctcactttcctttctttttgaaaaaaaattttttatacattatgtttttattttattttacttatttttatttttttaatattagatttttttctttatttacatttcaaatgttatcccctttcctggtttcccctccaaaaacccctatcccatccccactccccctgttcaccaacccacccactcgcttccctgtcctggcatgcccctacactggggcatatacattaggttttgagcgaattccaggatagccagggctacacagagaaaccttgtcttgaattaaaaaaaattttttttttaaattagagttgctgccatgagtatgagcaacttaagaaaattatctctcgccgggcagtggtggcacacgcctttaatcccaacacttgggaggcagaggcaggtggatttctgagttcaaggtcagcctggtctacagagtgagttccaggacagccagagctacacagagaaaccctataaaaaaataacacacacacaaaaaaaatcaaaaacaaaaacaaacaagagagagagagagagagagagagattctttccctccaacttctcccagaccttccctacctccattcccaccaacttcatgtttttttttctctctctctctttctcaaaaccaaaaaatgccaggaaagcaacaaaaaataagtagcaagaaagtcagaacaaagaaattaaatacgtaagtaagtaaataaaaatagaaaatcagcaatattaaaaaaaaatcaaggactggagagatggctcagcagttaagagcactgattgctcttccagaggtcctgagttcaaatctcagcaaccacatagtggctcacaaacatctgtaatgggatccgatgccctcttctggtgtgtctgaagagagctacagtgtacttacgtttaataaataaatctttaaaacaagacaacacaaaaatccaaaataaaatttcaaagtgtaccaacacaaaacatgtagtctgttttgtgttggtcaactactcctgggtatttaggcttccttggagtgtggttgctatacccagtgacactcagttaagaaaagtgaatttccctttcctggcagggatcaattgcaagtagctttttggttaggggtagaatattatattccaccttcctgtgctggttccacctgtaaatgtctgtgcagagctgtttatgtttacgtctcaggcagagctctgaggaagatattagtaagcaagacattccttggagagtgcttgggggatccagcaactgtgaaaggaaaaagaaatattaatcaaagggataaattaaccttcaatacagtttcagcaaaggcctctcatggtgctgtccccagttgaggcaaggcaacagacctttttcctcaccaaacactcactggtgtaggggcatggtatgacctgtcatcaggcagggaacattcaccacacagagtggagaggagctgtggccatctcttcaatcagagcagggtgttggatggacgttgccagcctgtaccacccaccattcacatcagctgctctgtgcacacagcacactccaacccacagagaaggtttgtttctgtttttatttttgctttttattattatctcatgtaaaattattatttattttatttttgctttttttattattatctcatgtaacccaggttggctttaaatttgttatgtagtcaaggaggactttgaacttcttccctcacctctagagtgctggggtcacaggcacgtatcactattcctgttcacctggtacttggaatcaaacccaggcttcatgaataatagacctaaactcttccaaaccaagaagaaccacatctcacgagatttgacatgctgtgggtttttttttttcctctcccccctctgtctctctcctcttctgtccctctttctccctcttctttatttctttcatttttatttttacttttgaaaagaagctggcttcaaaattctccatatggctgaggacgacttcagcctttaatttctttttttgtttgtttgtttgtttttctaggcagggtctcactacacagccctggctgtccttgaactcactatgcagactaggctggcctcgaacctggagatctgcttgcctctgcctcctcagtgctgaaattgaagacttgcaccaccaaggtatttttagttaatcgtttgaaaaatttatacatgtttacaatgtattttgatcaaatccaacagaaatcttcctctcacttcttctcagtccccctacatctttcctaccataatttctctctttctcttctttttatttttgaaataacccaccaagtccagatagtactgtctacaagtgcataaatgtagagccatcggctaaagcatggccaggctactagtaatcccactgaacattacacacgttctttggtcaaattaagcaagcttaattttctgttagacagggatagctccctaaatcagactttgataatatagcatgacacttaagagaaagtggggcttgtagagcctccaaaacctgcaagcctgggggttttttaaggcttgggagacttccagaggaattttgattgcataggaacttggctagcagaacatcttatcttatcagggtgcattcaaggtgtgagtcaggctccagagggtggggagcaagtcggattccagaaacacacagtgagtgtttggtgaggaaaaagcacagtcaacctgaattttgcagcagacagaaatgaacttctgaccttataacaaaatggcttccgtccttaagatggcgtcaggctggtccatcagtaactacacccctgaagaaaagttatttcctctccctaactgtcaccaattgccagcaacttctcagctaggaatagagcctcatgatttcctctcccactcatactgggtgttgactggcttgagtgccatgccacgtcctgaagacagcatttcacagcatttgtccctatcctctggctcctacggttcttttgttccctctgctgagatgtaggtaccccgagccttgtagtagaagtgacaggcatgtcccatttatggatgactactcaatggtcacatactctcagaactgtggccagttatgagtctgtgttgactgctgcctactgcaaaaggagtcttctctgggcaaaacagtagtaatctacatgtataaaacacaaatgcttacaaggtagtttgatgggggggggggactgtcaaacaacccttgcacaggggtcacctaataccatctgcacaggggatatttgtgccttccctcagccttgagtaggctaaacaaacccatgatagttttacaacctagctggagtcttctgacctcaccacatttgcaatttcctatagagctttgaggagtagactgcccactgagcttgctttgcaacataatctggctgaaacgaaggatggggtttgtgggctttctcagtgctgaaaattaactttgagccttgatcagaaacgtttgtctttgcttcatccttctcttgcacccagtttttttctcagttccaggcccccccccgccccgcccctttcaggtatacccagtttgtccatggccactggacagctacagatatttacattacgattcacaacagtagcaaaattagttatggagtagcattgaaatagttttatggttgggcatcaccataacacgaggaactgtcttaaagggtcacagctttaggaaggctgagaaccactgtcctgcagcctagctctcatgggtccttgataaggtttgtagcaccagacatgaactttttcctgtggagcagccctcaaagacagtcagaaagagcagttggttatcccaacaaccaacatgtcactattatatcaagggggctttcctatagcgtgaatggtcctcagagggtaagtccatcttttctccccacgtcgcagggatagcatttcctggcaccatgaaagcaggccagtagaaaggaagtttctaaggaccttgtacttctgatcctcctcctcgcatgtgttgggattacaggcctgcaccaccacatccagtttattaggggctaggcatgtgcacagtaagccaacactcaataagcagaacgacactcagacctcagccccttcatttagtgttagtgtgttggtggttgtttattattattattattattattaattcaccacacagcaatttatgtcctacatgtcacattcatttttaaattccctttactttttcccctactttgttttagaatatatgtatatgtgtatgtgtatacacgcacacacacacatacatatatatgtgtatacacacatacatatatgtgtattcatgcatatacatatgtgaatatacacacatacacacgtatatatgagtatacacacatatacatatataatatgtgcgcacacatatattttatatattagcattccagcttaggggcttcagtgtagctcattggcacagctcttgtctagcgttccagttttatttctacttttggcttttaagtctatttgttctattgatttaaagcttacagtacctcggtgggggcacacacctttaatcctagcactctggaggcaaaggcaggtggatctccgagtttgaggccatcctggtctacagatcgagttccaggataaaccgaaagtagagaaaccatgtctcagaaaccaaaagctaaaacaaacagaaaagattcacaacaaatatttttaaatcattacaatatattacaatatcattaatattacacccctttaagggtagtataagaatctttatgttatgtgtctataaaatgggttgaggagctggtgagatggttcagtggatgaaggagcttgttagcaagcctgccaacttgagttcaatccctaggacccacgtgataaaaggagggagtagattctttgaagttgtcctctgacctccacatgtatactatgtcacatgtgttcggcataaaataaacaaaaacatagaagggagcctaggagacagtgccgttggtacaaagcctgctgcaagagcatgaagccctgagtttgagccctagcactcggtcttatgcatacagcacatgtctgtaatctcagcactggggagacaaaagagtgagtggccctggagtttgctgggctgccagtcaagccaaatcgactagctccagatagggagtggggcagagaaagactgagcccatctcaatggtgggcaatgattgataaagacatccagtcttgccttctggcttcccataagtgcatccctcagtgatatactgttacctggaagagtaagccaaccaagccctttcctccctaactgattttggttggaaaggaggccatttccatgaagctaggaattgaccttggatggaagatgctggcggaagtttctggtttagtccaggtggcccccgaagtgtgggctacaccatttcccagaaacctctagtaggcatgcactccagctacccatgctggacactcgttctttgatctctctcgtttactttcttattttccttatattatttgctcgtttatccccagacattcctgggactgtcttttacacaaattcttcacatcccatgatgtctttccggctctccgtcttggaagaaaacacccaagtgactgactgtgaccaaacggttacatgcaaatgtatgaaatctggggacgaatgcagtaataaaaggtgacttaaaggggctggagtgatggttcagtggataagagcactgactgcacttccagaggtcctgagttcaattcccagcaaccacatggttcacaaccatctataatgggacccgatgccctcttgtggtgtttctgaggatagcaacagtgtactcatataaataaatcaatcttaaaagaaaataaaaaacatttcattaaactcgataataggtataaatgcgaacttaatggatgttctcagggaagttgactgtaacttgtaatttgttcagtgaatagcaagcatataacaaccagacggctaaaactaccacaccgctaccacacatgtttctttacgtatcacatctgcatttccccttgcctcaagcatagtacttggaactttgttcctcatattttatgactgccttcatttttttagaaaagagttgttactattattatatgtaagtacactgtagctgtctttagacacaccagaagagggcatcatgtggttgctgggatttgaactcaggatctccagaagagcagtcagtgctcttaactgctgagccatttttctagctcaagtgcctttgttctttttctggagtttctggatctagacagtgtgccttaattttgttcttcagtgatgtttccagcctgcaaccgagcttcccttcctcggctggaaacccatctttgccttctagattcctgaagaggttgaatttcatgtgctgactacaggtcccttcttcaaaacccattctgccctcagaatctatgaacccgatttaaaaaaaaaaaggatttttatttttatgggtttggctattttgcctgtattcatatctgtgcaccacatgcatgaagtgcttgcagaggccaaaagagggcgccagatatcccggaactggagttacagatggttgtgggccagtgctctggaaaaacagtcagtgcttttaacccctaagctatctcaccagccctcatcttctcttagaccgagtgctagggctcaaactcagggcttcatgctcttgcagcaggctttgtaccaacggcactgtctcctaggctcccttctatgtttttgtttattttatgccgaacacatgtgacatagtatacatgtggaggtcagaggtcaacttcaaagaatctactccctccttttatcacgtgggtcctagggattgagaagtcatctgtgatttttgacccagctgccctacctcattttgcagggaacagggatggggatgggaatggcaaagggcaggacactgttccaccttccgcctcaaggctgttaacaaggtggtttaatactgaattgccagcccagcccagcccagcctttcactattttcccggtattgtcaaacatttcctccacactacctatagaatattcttacttatgtttaatgatctactttagtgtttattttaagtacatactatgttccgttccttgacctcgctgtactttgtttattcgtaaatatacttacccacctgttgtaataaaaatgtccttctgtccttccttcctttcttcctttcttcctttcttccttccttccttccttccttccttccttccttccttccttccttccttcttttctcccttccttctttcctcccctccttccttctttcctcccttctttctttcctcccttccctccctcatttctttaacgttcaaccaatgtttctttctcacgtttcctttccaaggtcagttccgagggctggacaaccacactaagctcagcggctccgcacatcctgccctcgtggagcccatgttaaagagaggttggtggagacacgcaatggacactggagacaacgacttagcttagtaccctaaaagtgaatggaggatatgcaaaaataagatagaggggagagcaaaggaatttggcgtccagcgttagtgtgtgtgtaggagtgcgtagtaaagagcagaagctcgttacgtgtgcagcggatgtgagagtctcacagagggaacccccagcgctaagttcctgaggcttggtgggtcaaagaacaaattaacctcagcatagttacccttccataagcaacaaattctccaggtccactaagcctcgtgatcagcagcctgtacagtcacttatgaggaacttttatagggagaacaggatgtgatggtgtatttaaacatatgtatttaaagatggctcagtgaataagggtgcttgttgcccagacctgagttcaatccttgggctccacgtgggggaaggagagaaccaactcctgatcctccacatgaatgctgacatgagcatgcacataagcaatacatgagtctaattttaaaaaaggaaaaatacctctggttaacatataataaattgctattcttttagatggttggattcctaatacacaccagcacagagtgaacgcactgggtaatgtacaatagcaaggtgacttacatcaaactacattaaatgtttaaaacagtgaaaacctgaaaagctaacatttttgtccaatgtgaaaaaaaagtcttatttagtagcatgatatacacagaggtaaaaatagatatcagaaagtcccccacatatgctaatcaattttgttcttaatctttacatatccacttatttttgtgatatctttattttatgcataagggtgttttgcctgaatgtatgcctttgtaaatacttgcatgcagtacccacaaaggccagaagagggcgtgagatcccctggaattgaagctactgatggttgtgaaccaccacgttggtgttggaaatctgacccaaatgctctgcaagagtcgccagtgctctgaaccatgtccaagttatctctccagcattatatatccacgtttgaagtagaggtacattgggcttttcatttttatagtggttacttaaagcatagtctatgctgtttttaagtgacagaatgttgttcattgtatttaaaaaatatagacaaaaatttaaacactttaaaaaatattatttttctttatgaagatacatgcttttaaggggttctgttggagaatttcagtagcgccaacttaaaacaaatactttattagggctgtagaaatgacttagaggttaatagtgtgcactgctcttgcagaggatccgagtttggtccctagcacccatgtcaggggcttacaacacaacctcctgtaactgatgctgcaggggatcccaccccctcttctggcccctctcatgcacaacacacatgaggcaggcacagactgatgcacatatatgtgaattaaaccccaaataaaatcgttttcaaaagtccaatgaatgtcttgacaatgcttttataatcaattcattcatgacaggtggttccctgtgtttgtgatttctcttcaagctgcgcatcaaagcaacccctccttctccctccttccctccctcctcctcctcctcttcctcgttctcctccctctctctgtgcatgtgtgcctgcttacctgtttgcgcaccgcaggcgtgcaggtgcccacggagtgattaatgaattctttggaactgggttacaggcagttgtgggcgatgtagtgtaaatgctgggaaccaaactcgggtcccttggaagagcagcagtgctcttcacagatgagccatccctcaagtccccaagaacttgtttctcttgctcagcttgcactctccaagacttaggaaagtgcttagtgaataagctggggcacaaaagatgcggttataagaaggtgacgtaggagcctctggcaagcgatgcagatgccaattctcacttgtgttccggtccctctcgcttttgtcagttttagaatgttctaggctgggtttggtgctgtcgtagcacagagaggaaacagcatgaaggacaaccaggccagagatagttgatggtctgagccttttgtttgctggcttcactcgctccgctgttctaaagcttcagtcaatgggtctatgttgaaccagtttccgctgttcactacaaagatgcaattggaagccgagggagggagggagaagctctggagagtatggctcagtggttaagagcactgactgctcttccaaaggtcctgagttcaaatcccagcagccacatggtggctcacaaccatctgtcatgggatctgactccctctgaagacagctacagtgtacttagatataataataaataaatcttagaaaacaagtagctgagggaggagttttttacttgtctcatccagggtgcctggaggatgacggcgaggcgccactttgcttacctcaccaagtgagagggacaaaacatagttttgatctgcagtagcttcgcggtgagcaccacatctccacctagtcctccgctattgtcggctgctatgaacagaccctgctgtcacctggccatttatctccatggtcctgtttaagctctagcctattgactaaggggatgcaagttgaagtggatgtccccacgtttgaacacagcactacatgctggtatctgaaatctgagtcacatctaggtcagtcacattttctagatttatgagtctagattttatttttccaggtgtcttgtttttctgtctctaaatgatgacatccacccccctgccttcccccccccccccacacaccatataccctgggtatggttatttgtagcaaaatcaatactcttgtacttgaataatttttttctttgcattttgaaccaaggtgtttattcacaaaaggaagaattgtccatttgtctgtctgctcagtctttggcttagcatagggcatgtgcagaggctcaataaaaatcttttgcctcaatcagtacatggcacatgcattacctcagggtcatatttgtaaataggtatgggtgtttgcctacaggtgtctgtgcaccacttgcatgcaggtgcctgaggaggccagtagagggcatcagatctctgggaactggagttacagatggctgtgagtcaccatatgggtattgagtacaagagagactctggaagagcagacagtgctcttagccactgagtcatcactgtagcccgcatgccatattattaaggaggctgaacaccaagtgattcagcctcgctacagacaagtagaaacctgtctctggcctccttaaccacaaagttggggggcttccctcgacacagaagccagagaaccatttgacaccgttcctctgtcacaggctgtatcattggtccattttccacatgacactgtgcattcaagcattcatctctgcagatccctgggcagtatggcagtgtgtgtgtgtgtgtgtgtttgtgtgtgtgtgtgtgcttgtgtgtgtgtgtgtgtgtgtgtgtgtgtgtgtgtgtgtgtttgtgtttgtgtgtgtgttctaattggaaaggaaatcttcacttgcctttaaagtgcagtgctactatatttctttgcaaatatatatacgtatatgcatatgtatatgcagatgtatacacacacacacacacacacacacacacacacacatatctcaaagttcctttcaggctgaagaatccattattgtcgggccagtgagatgacagagcagtttaaggtatctgctgccaagtctgatgacctgagctcaatccctgaaatccacaccgtggaaggggaaaactgtctcccacgagttgttttcttgaccgccacaggtgtatgcaaatatgcatgtgcacgtgcacacaagcactaaataaacagaaagtttaaaaaattaaggtatatattatttactatgtaagagaacatcaaaaaagtcttgagaagtacaccatgggagaaaacacacctagcccttcaaataatttgcccttctagaaaaatcctgaaatagccctttccccatacagtagtagaatgataacattatctcagagatgagcaggcgtttaaggctcagcggaacgggaagagagttgggtttttcttcctatttgttttgaatagctctgctcccgggtcctctgcttgcccagatgatctgtgaaatgggtgagtgagcagcgcacctccccagcgcgactgttactgacgtcagcaagcctcattagctgctgtttgtctaaccaaagggaacagcgggtggagagaatcttaatgacctgacttcccacactgcaggtgccacttgcctggtgtgcacgctgagattgcatcagctgactaggcaaacaaggaacagtggaaatgggaggcagagaaaaagcccaagagagactgcccagtgagtggaactcgctgctccatcctgggagagtgtagcagagatgtttgtgcgtggtggagtgaggtcgactcaggttcacagctgtgcgctgctacatagtagttgagggtcgaatcacttaaaggctttagtcccgttttcaaaattaaaatagggataatgatagaaccttagggagaaggagggacacgtgtgtaaatcacagacctcattgtaccactggataactggcaggagccactgtttctgactctacagtggagagaagggaagagcaatgattggcactgtggacgcaggtggcagagaacagctaaagatgactttatatcctaaaggcaagtggggtagctgtgagttttaaagaccgaaccttgcttcacaaaattgctcttgctttcctacctaccaattctgcgttctttctttttccctggcagcatctccccggcggactcagccttggctacagcggagactcctgggaaggaaatgtccttccccagccctaggcacagtggttattgtctgttctcacatcctgtgagccctgtaggcagaggaatgccccagaaccacagcaactgtgcaaacatttgaattcccacgggtagtttcccatcctcgtacccatgaggcttctgctctctgtagtcagaagaacgtacacagttctcaggagcaggaagtagagggctaggaatcatgggtgaggagcctagcatgtgtgtgaatacatccgtggaaaacgtttttgagggagatagtacagaatcctactccaggtgaaataatgagactcttgctaagaccacgtacggatgacccaatcaatacacaaggagggagttgaaaaggagaaaaggggttggccattaatttagccaacgtataattccacgtattagcaagtaactttaattatcctatgcgccctcggttttattctccacagctgtaaatggtaataataccccctttgaacatttatcatgattaattaaggcagtgttgttgaaacatattgaaagttacctaggctaactttgtccaatttgccagctgctttggcaaatcctctgcactggggctggctcaggctagaactatcttccatctgggtaaatctcttctccattccagagcagatatcatggcgggtagcttgacctcacagtcatgagacaactcaaaccatggggattggcaaatgaagcaagtccttgttattgaactctccactcagaaaaaataaaaaataaaaacatattaatactacggaggattccagtgacactcccttctgggaaagacactcaagagatttttatgagcagtcagggcagatggaagtcacaaggcaaacacctcaaagtaaaaaaaaaaaaaaaaaagatcaacataccagagcactcaacaagctgacagtctggctgcccatgctagatgcttagaatacatgaatgacaaagtttgtatgcagtctctgcctttagggactttactgctaatgggggattgtttatcaaacctaaataatatccttgagggaatattactatactgtgggtattagtgttcttaaccaatatgggtgttgactttgtctgtgtctctctctgtgtgtgtacaacgtttgggagtcaattctgtctttccaccacatgggtcctggctatcaaactcagtctctcagcattactggaagatgcctttgccccatgagtcatcttgacagcaaaattgggtattgagaacttgaaagtttgctgtgtgaagaataagtaaaacatgctaaaaaaaaaataaagtagacaggctgcacagatggctcagcagttaagagcactggctgttcttccagaggacccaggttcatttcccagcacctacatggcagctcacaactgtctgcaacttctgttccaggggatccaactccttcacacatgcaggcaaaaacaccaatgtacatacaataaaaataaataagttatataaaaataggcaatctcatagttttaccatgttaattatatgttaaactagcaatgtgcatatattgcattaaataaaaatgattccttaactaaattaatttctttaattaaataaaatgcaaaaaaatgaatgaaataaaatcactttcacaaggtggagaaacactttgggaagacatccagatgtgaacctcaggcctccacatacacaaacattaataagtatgttaattaaaattaatttcactttacttttaaaaatagaactactagattgtttaggatagaatatataacttctgcccaatatttgctcatattcttttggaaaatatgtgttcaaatcctttgcttattcttaaattagattgcttgcttttattgttgtatttttttctatcccaaatagccaaatagtatatttgtttggaggtgtatgtggctgttttaagacaggatttctttttctttttcttttttttttttttagctctggttatcctggaactcactctatagggcagattggcctcaaattcacagagatctgcttgcttctgcctcctgcatgctagggttaaaggattgcactggtgctgggcatgacaacccccccccccctttttttttaaccttcactggtatagtacaaatatggcacacagaccattcacccatacacataagagaaggactaaacaaatatgtttaaacattaaaaaaaaaaaaactattggaaacggaatcgtcaaactggaatggtggagatttcatcagaactggctttgttcattttcctgtctccgtcaaactgtctgctctgtcacagtctggttctccaccacgtggctgctgcttctgttggttcagatccctgctccgcagtctgagccaatgaaatcccggctcttcacaaaggcggttttagtggcaagtctttggggcttcttctgttctcttggaagaatggccccagcagcttcttccatagcgcttctggtgaaccagatggcatcttgttcaacctcttactgcactgagcacgcagcctccccttacaagattcataccaatgtctcattgttttccaaagtaacttgagacttgaactttcccagactctcaaataaaaccattccttgtggaagagtgcggtggtctccagtctttagagactgcctgcctacctaagctttaggggacagagtgggacaacactaacaaggtgtgtgggcatgacaacctctaatcttctcagctagcttcacctggaatctcagtcttatgagtaatctggactaacagtaagggactcattatttgatgcttgccacatctggggtcaaatcttggcccctagaaatgggagatggatggacaaagatgtcctatacctttagctataccttctaagaattcagcctcaacagcttggagacagacgggaggacaaacagggtgggcttccctggttgctgggcccgcttagggcttggctgtaggctgaaagggaagggagcttgctctctcggccacacactgtacttgcatctccatcgctgggatgcagacagtgaagagaacagaccgtagctctgcttgttctgagacataggaaagcgctccaacaaatgtttcttcacctatcgtatgctctgaggacaatttccacagactctagatgatcatcgttgcacaatttttaggaatcttcgcagtttccttgaagtgtgtcctcaagagttcctgatgctgccgttatagaagtgggagtagttgggggttttatagacaaactctaaaactaaaagaaggagatatacacagttacagaagtgtttggtcagcaaggagtcaaaaaattagccagtgcacactaggcagcatattaaagtatataatatagtatatattatatactatatatattataaagtaatgtattacaaagtaatatattactatatattataaagtaatatactataattaatatataagtaatatactataacacatataatatataacaaatataacatataacatgatatattatattatattatagtatagtatagtatagtatatataataagatactactggctactaatccatccaaatctagaatgaaccctgtgtaaacacacaggaaaacagtgggaaatctagtagaaaactggacaataggtattaataggaaattcacagaaggcaaaacttttcaaaatgacaagttcatgaatggggctttatcactattaaatcctttaaaatgcatttaaatgccaaggcgatggctcagctgttaaagagcttgtggggggatcaggaggaccagagattggatcctagtatctgggccaatgtcagaaggatgtggcagcctgcctataatgctagctttggaaggtggagtcagggtatccccagaacaagctggctcgtgggattagccacattggtaagctctgggtttaattgatagagcctgaatcaatgaagggaggagagagtgacacaaagagactcctgatgtcaacctcaggactctcttcatgtatgtggacacatgtgcatgcacccacacacacgtgtgtccacatatttgaaaacagatatttacatacaatacacacacacacacacacacacacacacacacacacacattcaaagtaagtaagtgcataaaaatggttacattgtagcagtttgtatatgcttggcccaagggaagtggcactattaggaggtgtggccttgttggaggaagtgcatcactgtgggggtgggctttgaggttcttttttccattttctctatttgatttgattactacagccatgaaattatgatgatctacatatacagattttatgacaagaaaagaaaaattcataaaaattttgaagctggagcagtgattctgttggtaagatgcttgtaagctctgggctcatatccacttatcagtgagtgcatatcatgtgtgtccttttgtgattgggttacctcactcaggatgatgccttccaggtccatccatttgcctaagaaatttcataaattcattatttttaatggctgagtagtactccattgtgtaaatgtaccatattttctgtatccattcctctgttgaaggctttgaggttctatgtttaagctctactaagtgcagaagaaagctctcctggttacctttggatcaaaatgtagacctctcagctccttctctagtaccatgtctgcctgcatgccgccatgcttcctgccatgatgataatggactgaacctctgaacctgtaagccagtctcaatgaaatgttgtccttcataagagttgccttggtcatggagtctcttcacagcagtaaaacccaacaaatatcactaagcaatttttaaaaataaagctaagggctagtgagacggcttggcggttaggaatgcccgctgccaagcctgaagacttgatgagtttagtttccagaatttatatggtggaaggagagaacaaactcttagaactgtcttctgaccttaacacacactgtgtgctacactcacgcctacacaaatgcatgcccacgtaaacaaatagatgcgaaagtcaatgtaaatacaattttttaaaaaaaaatgaataacatgcagttaagatgaggtcatattatactctcaccattggacaaaacttatatgttattgtcctcatttggttctgttgctgggataaaatgcagaccagaactaacctgtggatgaaggggttcattctgtttatagtttatcctccttcactgagggaaggaaaggtctacatcacccagaggaagaactgaatgaagcaaagaccatggaggaatgatgcttactggcttgcccccaggctcagggtcaacgacctttctcatgcctcccatagccacctgcccagggatggcccagctcacaatggcctgggtcctgtcacatcaatcaacaatcaagaaccttgcctcacagacatgcccacaggccatccctcaaccaagatctctccctcccacatgactacagtttgtgtgaagttggtgaaaaccagctagcagtttatcaaatcttggtgggaaaaagatagagagacagaactacgctttgaggagcaacttggtggtactaagtgaaattaagtatatataattatggctaaggaaataacattcttgggttaataccttagaacatcttccataaacaaactagaggaaggtaatttaaagcacaaataggcaactaataccatcttaaactaacctacacacctacgggttatgaatggtgaccacaggctctgtatgtctactaagaaataactatgtgagtcaaaatgaaagaaccaatcgatctacatacgccagcaaggacggtttctaactgtgcttcggatcgtaaagataacaaagcaaaattagatgatagcatattaaaggttatgtaacatgtgaatataatggtttctgtggttcattgttacatccgtttatgaatgaagctgtggttggtgaatggtatgcattaggataataagcgtgggtacctggtaagagaagagatgaaaatggctggaggaggcagtgattacagttccattcagaagggaatctagagcctgggagatggcttggtaaagggcttgccaagcaagcatgaggatcgaagttcaaatccccagtccccgtgtaaaaagctaggcagagcaacacatgctcagagccgaggagtcagagacaggcagatctctggagtgcactagtcagctgactcagctgagtccctgcactccaggtttagggagacactgtctcaaacaaacaaacaaacaaacaaacaaaacagctggaatgtatgctgacttagttttacttgacatagctagagtcacgggagaagaggaaacccccaattgtgaaaatgcccccactagactgacccatgggaaagcctgtagtgaattttcttagtgactgctgtgagaaggcccagcccagcatgctgtgagtgggttgtcctgggtgctgtaagaaagcagactgaacaagcatcgggaggcaaaagctgataagttgtcccttcctgtctccaggttccttccctgatgtccttcactgatggagtgtatctgagagttgtaggctgaagtcaaccctttcctccccaagtagacaggaggttagaaagatagccctgtgggtcagagtgggtgcggtacaaataggaggatgcaccttcatatctcaacctttgcatgagcatctgggtgtagacacacttatgcctgtgacacctccttggaggtggtgatcgtgggactgactggccaccagcttagtttcaggttcaataagctaacctgtctcagggaagtaagatgaggagtgagagagtctggaacaccttctctggcatttgcacgcacatatggatacctctccacatgcttatacagtacatacatacactccactggcatgcacacgtacacatgcacaccaacaacaaaaaagtaagttgaaaaaaattaaagaaacactccatgttaacttatggcctttacatgcatacatatatatgtgcacacgcacctgcatacacttacacagagggagagattacataggcgttgtcagcagtgtgctgcagacaaagaggtatgatcagtctttctgagatgaatcttagtgatgaggattccatgatgtatgagcaacagggctgggcagtgcagccagctggtgctgcatctcctttcagtttggattatcttattgggtcacaccagaaccagggagataaatagtcaagacagactttgaaaattcatacaccacacacacacacacacacacacacacacacacacacacacacacaccaataaagctaggtttgaatgaattacttttgtaaaatccaggtctgagttgtattctgaaagctttacttgtttggactggccagtagctcagtcaggcaaaaagacaccacacgggagggcagactttaaagaagaacgtttcaatgaggcaagctgtcacggcttgtgtgaattacacaatgaaagggaaaataaaataaaactatggcgggctaaaatctgtaagttctgacatgtggtcctcgtggcaccatctgctcatgaaagcatgaagaggcttctggaactttccaggactgggttgatttgtctccacaaagctgcctgggtaagaccctgtggcactgggtcatcaagaaggtactagcagacttcctttttatctcagtatttttctacgtcagtccccaaaccatgaaacaacagggcttaccctgccacaccaaaggtcaaactatgttttctcttacccaactattgcctgggatggctccaactttattactaccccacctccaacccgtaataactctccagctctcacttcaaatccaagagagtgtggactgagtgaggggaccagagacaggtgcatctggtagaaagttatactcaattaactaactgaatgcatttgcatgtggttttaattccactgtgcagcaatttcctgagtaaaaatggagagattatatctagtttttgagtcactgtaagaattaagtaaacgtagctctcaatctatatctgcacattatttttcctcgtggtcctagatttctcttgttcctgaccatttgtcccgtcttggaatttccccagccttcagaggtgtagccctataatttaccgtccagattgcaatccctcttcatggcatgaattaagtcttatctcaccaggaagtgctctttcctttcttctgactcctctccctctggctttcctcttcatttcttctctacactgtttagggaaagaggtttcttagcaaatcctcagacaccccaactagtgggcttcccggaaagtctcagccgtgtgtgggaggtctgccctgaagaagttctttgccagaaaatgaagcaaggtgttctggctggacagtgagggtggtagactgtaataagtatgtctggctttaactcttctatattcatctgaggggagcatctgagcccaacacaacatctccatcgtcaatggagaatcctactcagctgacaaggcccttgcttctgtgttgaaggattacagcaatggcctcctgtttattgacctcatacttagacccatgaggcatgcatatcatagtttatttctcctacttagcaactgaaaatactaaagggagtcacagagtctgactgctctcacggtctgtatctattgcttaatcgaaagcttccctgttaccctcccatagcaaataagggtccatcccacaagacactgtggaaacgcctcctctcaagctcctccagacctcgcagtgagtcaatagagagcagaggggtcttacgtctctggtgcctaaagaggatggggtgggcgttaggtctcagcaagaacatctcttcttatgtggccagcggagagcccagaaatcttaagctttttcataagggtttctttgagacgcttcctaacctagtgatccggttatcaccaagctaagggaaaacgatcacgtgacacgaaggatgaaggaaaaccctcagattcctcctcctctgaatctgggagtggaaaactgaggagctgagctcagagttccagagccacgcgaagctgggctcagcagtgtttgcagctgcaggtctggtgagcctgtggaaagagagaagggtgagagaagagagtctccaaaaagctgcccgaattagagaaacaagagaccctgcctcaaaaaggcagacacctcaagtggtcctctgacttctgttcatgtgtcatgacacgagcatccctgaatccacatacacagctgagaagcgtgtacacacacacacacacacacacacacacacacacacacagagagagagagagagagagagagagagacagagacagagacagagagacagagagacagacaaagagacaaagagacaaagagagagaaacagagagtggctgaagggagggggcaggggaaggagggagggggagggggagagacaaataatttataaaaggaaaatcatttaaaacatttcagggctgccgagatgacgcagttgcaagcaggaagccctgagtttggagccccagaacgcatccaaaagccaggtgtggagcgtgtgtgttctgtatctcagctctggaaacaagggcctcgccatctattgccaatgggctgccaaaccaacaaggagcgagcaagccccacttttcacgtaaaatacctcaaagagaaaagcaacagatgcaaaggggagagaatctcgcttttgcccagatcatgtagcagccccgctcttagaggacgtactccatgtctatgtgacttcaactttcaattctacaaaaagggttggtttcatccctctcttctcaatctggaaacagttcgttttaacgacagatgggtgatattacacttagaatcaaactgttaagccatgtgaatgaatttatggtcacgtcatttcgaagcgtcccctctacaacccccctccccccgctgggaaaagaggggcttcccgctttcccaggaagggaagctgtgggctctgctgggggacacacactgagggactttcatcagcatccctcccaagagggaagggacatgtctgtgggccttatggtcttcaaagggacgtaaagccgttgcattctgattagtttgtggagggtacttgtttcaatccagctacagtttggtttgtgcagctggtatctgctgagcagctgccgggacctgtgtactctcgaaatcggtgaggctaacccctgagaagcagagggtcgggtgtcacgagagacttttctttccctttttggcagccatattgaaagattcacagacacgctcttaacttatccatgcaaagtgagactctgctcacattccctgatactttccttcaaaatgcaccaggaaatgtcaggaaataattcaattagtctcaggaaatttacaaactgtgcaaaacgttttgaatccacttttagaacactttcaatgaccacaaaagctgaagaaagggcagaaagaggcaagggaaagaggaaaggaagaaaggaaacaaacaagcaaacaaatccagtttgtcttcagaaggattatgttggaggttcgttttgcttgtagagactagttcatctattccaggcttgctttgaattccctgtataatggagacaggccctcaacttctggtccttcggcttctgtgtggcattacagttgagtgctatcacacttaattatgtcagaggcgtttttgtttgtttgtttgtgtttatgttttactttagcagtggctggagttggggtggggttgggttactccagcagctcccaagaggatcagcctttcaggctgtcgctggaagggcagctatatagatgctgcaagaaaagcaactagctcctgctcttagagaacttttgtttattattattattaatttactttatttacatttaaaatgttagcccctttcctggtttccccttcgaagaccccctatgccctctcccctccccctgatcaccaacccacccacacctgcttcctggccctggcattcccctacactggggcgctgagccttcactggaacaagggcctctcctcccattgatgactgactagaccatcctctgctacatatgcagctggagccatgagtcccaccatgtgtactctttggttggtgatttagtccctgtctgggggtactggttagctcatattgtttttcctcctatggggctgcaaatctcttcagctccttgggtactttctctagctgcttcattggggaccctgtgctcagcccaatggtaggcttcgaggaaccacctctgtatttgtcaggcactggtggagcatctcaggagacagctatataaggctcctgtcagtaaggtcttgtactcagctattaaaaagaatacatttatgaaattcttaagcaaatggatgaaactagaaaatattatcttgagtgaggtaacccaaccacaaaagaacacacaaatacgtggtatgcactcactgataagtggatattaggccagaagcttggaatacccaagataccattcacaaaccacatgaaactcaagaagaaggaagaccaaagtgtggattctttgatccttagaagggggaacaaaatacccatgaaaggagttacagagacaacgtgtggaacagatactgaaggaatgaccatccagagactgccccacctggggatccatcccatatacagtcaccaaacccagacacttttgtggatgccaacaagtgcttatggaaccttttatctatagagaaggtttctcagctttggtagcattaattaattcgttgtcatggaaaggtgccgtttacaggcatcccttcgcctctccctgtagttgccagaaacatcttagatatggatcaatatcttctggggccaggagatattcccaaattgagaaccattggtcagcactctgtctatcatgactgcaaacaaattgaaaacttgacaaacattaatgaaaacttgataaacattaatgaaaagaaactcagaaaacactttgatagtattttctttaagacatgccatgcgtggtggcgcatgcctttaatcccagcactcgggaggcagaggcaggcggatttctgagtttgaggccagcctggtctacagagtgagttccaggacagccagagctacacagagaaaccctgtctcaaaaaaaaaaaaaaaaaaagacagggtctcatgaaacccagactggccttgaactcactatgtagctgtactgcctgggtttgtgtgtcaacttgacacaagctggagttatcacagagaaaggtgccttccttgaggaaatgcctccatgagatctagctgtaaggcatttttttcaattagtgatcaagggtgggagggcccattgtgggtggtgctggactaacctgggctggtagtcctggattctgtaagaaagcaagttgagcaagccaggggaagcaagccagtaagtaacacccctccatggcctctgcatcagctcctgcttcctgacctgcttgagttccagtcctgacttcctttggtgatcaacagcagtatggaagtgtaagctgaataaaccccttcctccccaatttgcttcttggttatgatgtttgtgcaggaatagataacctgactaagacagtagccaacgatgatgctgagcctctgattctcctgcctctaccttctgagtactggatttacataagtgagctgtcacaccagtttatatggtgctggaatcaaaccacaaaggctcccagcatgcaaggcaagcattctctcaactgagctacagcctcagttttagcaatgcaaagaagaggaaaaggagggagaagatatatatatttttcattacatatatctcacatatattttacattacaaatatctcacatatattttaaagcgctgtagtggtgagatattgggctttgtagacaccaggcattctgctgtcctggttcttcaggctttatgatcttgaacaccatagttctatttggtgagtctgttttctcaggagttgttgactatgcctttagtccagtgctatctgaagaatgaagatagtatctctctcagtacacctttggcaagggaagataccatctgcccagtatcatcatgtacattggttgagagttaactctgtgctaagtgttgtggtaaatgcattatttcttattccatcctcatggcaatcctaccaaatgtcaaaaattattatccacaatttgtagataagaaaaccaaaactttgacacattaaatgactgtcttaggattttgttgctgggaagagacaccatgaccaaccaaggcaactgttacaaagggtaaacatttaattgtttctctgagcacttctgtcttccaggattctaccacaatggcctttctgctctatttacagtattcaactgtttttttagtacaaagttccaaggtcgtccacagtcctgcaaaaagcaacacaatcaggtacttcccagcaacggcgattcttgagtatcgatttctgtattatttaatcttctgttgctgtgataaaatgccacgactaaggcaatttacagcagtaagagtttatttgggcttacatttgcagagggataagcgtctctcatggtagggagattggaaggcagtgagtggggcctgacagctggaataggaagcagagtgatcacatcctttactgtgaacaggaagcagagacagcaaacagaaaatgggctcaagctaagaaaagaactctcaagtccagccgccagggatgcgcttccttcagcaaagatgctagctctccaacagcatccaccatctggggaaccaagtgttcaaacacacgggtctgtgaggaatatgcttgaccttaacaaagctagggaaatgtgtagactcctctacacagctggaagatgttcactctctcttctttcctttaaacagtttcttaaaaattatataacccactcatattttcctaggtgttacaatcataccttacctttaatcacattttcatttatttgtttgtttgagattttatgtttaattatgtgtgtgtgtgtgtgtgtgtgtgtgtgtgtgtgtgtctgtgactttgtgcacatgaatgtggtgcccatgggagccacaagaaggcatcagatcatttggagctgggaaagcagagccggaggcagggacatctggcagagttcagagtggacatgactagactgagctgggtcatgtggggagatgtgcagaggaagggaaaggggagagatgggaacaaggtgcggcaggcaagagagcaaagatacacacacacacacacacacacacacacacacacacaccacatatgtacatatacacatacacacatgcacgcacgcacacacacacatatttagatgcattgaaatcatttgatatacaaatagaccatgcaaagatcaagtcagtgtgatggacatttccagctgtttaaactttttaatacttgttagtattgagagtcccacccccaccccatttcactgctttacaaagatacaaaacattgttctgggcatgttgggtgcattccttaatcctagtgatgcagaggcaggcagatctcggtaagttgaaggctatcctggtctatacagtgcattccacgctagctagggctaccagtgagattgtttcaaaaaacaaaagtctgtagttatcttcctatattgtttattcttctctgccttcctctttttctgcacacctgtcttctctgacactggtcagcatgtgtgagtgcttgggcccgttaatttgtgtgagcagacatgtgtcaacatcacttagaggaaaggtggcagactcattaacacacacgattaacatgattaggaccagtttgaaagcagcagttctccatcttcctaattcaggcctgactgtgtcaggactctacactctctacactgttttctcagctaacttgtccttcctgtctctcacctcttccccacactgacacacatgtatacacagcccccccaccacatacctaccccccccctacaccacagacttccagagagagggaggtggtgactacgctgtatgtgtttaactgttacctgtctctccttagttctgaatgaaatggaatctaatcttaatcctttcctgtcattattagattcatggagtcctaacggccagagtctctagatcctgtcttatgaaattcaactctcatacaaaattcaaagtatcagtttcagagaaagttatttgaaaaaaaaaactgtggagttgaaagcaattgaggcttattctggtcctcttactcagtgtgtgtgtgtgtgtgtttctgtgtatgaatgcatgtatgcatggggtatacatgcatgtatgcatgtgtgttcatgtttggtgtatgcatgtgtgtatgtgtgaggtatgtgtatgtttgtgaggtgtgtgtattgtgtgcatatgtgagcacatgtgtgtgtgtgtgtgtgtgtgtgtgtgtatgcattcagagacagagtgtgctcagcttccagtagatcctcagctaggaggtggtatcttgtgagactcttccctctgcatgctgaactgttgaccggcttgacctgtgaaggtcttgtgcaggcaaccacagctgctgagagttcatgcatgcaatagtcttcatgtttattgtagttctccctaactctggttcttaccatttttctttctagtctgtgatgttctctggatcttgcaggacaggccataatgcagataccgagttttattgatgtcaatggtccactgggctagcagccttactgactctgggatagatgctgttaaatcaatgacagtggctttttaagttacatccagacgttaggcaggaatagataactcagatataacacgaaggcttacccctgtgtttttgattttaaaaaattgtgagtgtgttatacgcaggcatggttatgcacattgatttgtgtggttgtgggatcttatgtcagagggacttagatgtcttcctttattactaccgatgttattcttttgggacaggaacctggacttcatttctttttgccaggaagtcagaaagccccagggatcctcccatctcttccttcttaatttctgggcttctgtaggcatgagcaaaactatgcctggcttgttaggtcggcactggtatctgaacctttgcttccatggttgtacagcaagtgttcttaactcatgaggtcccgatttttttgttttacttaatgctatgttgtactgtattatattatgttttgctctctctctctctctctctctctctctctctctctctatatatatatatatatatatatatagactggcttgcaccatggagtatgtgtcagtcaggagataccttttggaagacagtgcctttaaaccattgaaccatttttctgcccatcacaaattctttggactaaaaaataagagtttctttttccttaacaggacaaaactttattctctgatatttaaaatataagagaatatttcaaaatttcaaaaaccagtcccttaagttaaatcaagtgcctgctccttcacatctctcttctcttttgatgtaagcacttattgatctaaactcacttcttgaaaactcggagcatctcacaggcttcgctatgttgcctctctacttccatttgcctcaagataatttttaatttctcttttaactatttcattagcctattgattattgaggaccatgtcaaatttcctaggttttgtgcccccctcctcaccggagactttgaaagaatgtatgtgctgcaaatgacaacttagtttcttgaagtttattaatttctttatgcatatgtatattttgcatttattttcactgttttgctcaatgtttgtcattgttctagtttcctttctgttgataaaacactctgaaaagcaactttgaagagaaaaggacttgtttagtttgctcttccaggtcacagtccattactgagagaagtcaaggtaagaactctaggcaggatgcgggagccgtgagggagtgttgtttgctggctgactctctggaatgttcaaactagttttattatatagtttgagcctgctagtctagggatggtgctgcccacagtgggctgggtcctcccacatcaatcaatcatgacattttctatgagacacggccacaggacaatatgatcaaagagatctctcaattgaaaactgaaaaaacttcctcttcaggtgaatctacgttgtgtcaaggtgacaacttgtccagtagtactaagcagggcagtcatctttaatcagagagatgacagtatatattcccttactgtatgggtttgtgttgagacacctataatggcagacagattaagtcttcctgcatctgctcagagcccctgtccaaacagttccttcttccctcttgtctctccttcttcagacagcctacacaattcataagcaggagaaaacatccataggatgttttccagttagtgttctagaatttcagtagtagaaaggatataaaaattacttagaaacagggagtactcaatggcaaagtgcttgcctggcatgcatgaagccttgggtttatcacccccccccccactcttagtccatatttatcatctttcatttaaggaagcttaaaataccagaggactagagagatggcttattggtaaagagcacttgttgctcctgcagaggaccagggtttggtttccagcacccacaaggtggctcacaaccatcagtaactctagtccaggatgtttgacatctttttctggcctctgtgggtactaggcgcacacatagggcatatacatacatgcaggccaaacacaaaagtaaaaataaaaaatattgtctaaaagctatctcagacacagggaagtgcagagatttatcctaaaccacactgttggttaatgtgaaagtcaagctaagataaataaataaataagtaaattaattaattaattaataagtaatagagggttggagagatggctcagctatttagggtgcctgcagctaggatgcatgttttgtttccaggggattgggggcatgagagaaaccttacaacctgctacagggaattggacatgctctcatggcctgtgaggatacttatacacagaagacattctctctctctctctctctctctctctcactctctctctctttctctttctctttctctttctctttctctttctctttctctttctctttctctttctctttctctgagacaaacacacacacacacacacacacacacacacacacacaaataaaaacaaatcttggcttatctgtgcatcctttaatttcatcactaggaaggaagacagatctttacaagttcagggtcagcctgatctacaaatcatgttttagatcaacaaaggttatgttatgagaccctatcctgtctcagagaaacaaaacaaacaataacaaccgctcccccactcttatggtaaaatgaaaagttactaaaggtaggacacccaagagcacacgggacgaggatttctaggcaagcatctttgtgcagtgttgcacctattattgaccagcattgtttcaggaaatgttaggcagaatcaccccgctgttctcggaagcaaaacagaggtgtcacaccttctgattagactggccagcttgcttttcaaatcatctcttctttatcatcaaagagagaaggaaacctcggaacaatgctgtctctgcaatgctatccccactcgatcttatccaaggctgccgtctttgttgccatagccacggagacctgatgcgcaggtatttgatcttgctatgtgccactgaagggtggatattccatcggagaccaaagaacaggaggttgttaagtgtgttgtagggaatcagagccatggagaagttgtttgatctgagtccagggctgagcaggacattggtacatcctggatgaaagctttacggtttgtacacagcttggagaagtttaagtcttggaaaagccgggcagatcccatgtgttaactcctccattgctgccagcctttccaagcctgtttcacttaacaaatatttattgagcgaggtcattacctccaattttcactacggagacttgaaaattaagacacgtactctgcctttgaggacctttgaggcacacagatgtaaactggccattggataatatcatacatgacacgtctgagacacgtgaggggaaagtagaaaagggtctatgtctcatacagcaaatgtataaagttctgtaggtaaagtgccatttgacatggctcctaaaagtccccaaagatagatttatttatttatttatttatttatttgcacatgaataatcaacttgttgaaggactgagagaccacagaaaaacaagcaggaggaatagcgaccatccaggaaagaggcttgactgggcagaagggtcaaactccaggagacagaagacaatttgaattaagattagccaatctcagagattccttatgaatggcttgatgataactcctcagtcttagccagtgggaagttttctaggaggaattctgattgggcagatctttagccacatgcaatgcccgagggtagaagatgtgtcttcttattctgggcagccacactgtcagctgaaaatagggtgtgtgggttgtcatgtggacagtggcagttcctataatccatgcctacctgtgctgtagctgcactccttgacttacacacacacactctctctctgtttctcccttcctcccccctctctccctcccttccctctctccttttgcagaggtgggtattgaacccccgacctcgcacgttatgatagacaggcacgtatccctgggcgctatgctgtactattaacgatttgtatccctttcctctggagaggagatggcgggcttttcaaaagaaagaaagaaatattcttactctatctatagtacccaacagtgtctggtacacctacatacacagatatgcagggcccgtggaaacacaacaattccactcctgtttaggcaacttttcatgctctttttttccctctgaacttggcttcatacagtttttagtgttcaaccttagtcttgttaaatccactccaccatagctcagcctaatcatcggcttttgaatggatttacagaactagacacacatttcctcctacagagcagaccttacgtcccatcagaaagcagttggttacacccaaatgttgtatggccctccattaaaaaagatgagcttatttgttttatgtgtgtgagtgttttgcttgtatgtatacatgtataacttgtgcatgcctgatgtctgttcaggtcaggagcaggtgtttgctggatctcctggaactggagatatagatactatgacctgctatgtgggtgctgggaatcaaatccaagttctctgcaagagcagcaggtgttctttttttaagttaatattttagagaatttcatacacaaatactgttatttacctcattaccaccccactcaacctggatcctacccccaaccactcccttctaaaatttatgacttcttcatttcttttttgagatttatttatttattttatatgcctaggtgcttctatctatgcaccccttacacggctgatgctcaaagaggccagcagagggcgccaggtcccctggaactggagttagagatgacggtggcttttcctccctttttaccaggagacctagtcctcacagaggttttcaggtcagttccagtttgattccttcaagtcctgtgtccaaagtgtgtgttgtctttagccatacgcgtttaatgtcaagttctgggaggcaccaaagagaacagcagaagccgctgggacttctctgaccaacagcacggaggtttttcatacacggtactagatagtttttggctcttgcagggagcattatagcccaagctggtgtaacaccatttaaagcacacgtaagcagtatatgcatatacttacacttgtattcatttatgtattatgcatgtgttctttttagagatctattataggtgtatgaatgttttgcccacatccgtgtacatgcaggacatgtgtatctgatgcctgagagagttagaggagagggcatcaggtcccctggaactggatttacagacagttgtgagcagccacgagagtgatggagactgagcctgtgtcctctacaagagcagttactgcttttaaccactcagcctcgccccgctacgcgtggatttttaagtaaacacgaaataaacttttcctttcgccttttcaaactcactttgtcttatttatgcctcttccctcttttccctctattttattcttccccctcccattaaagccccacccccttttctattcccccctccctttttgctaggacacagcaagtgctcttaactgaggagcagtctctctagaacccccgcccacgccacacatcttttagagctgaaaatttcctacagcttccgaaaggaagaatcaggatagagtttagaaatataaccaacagaggagaagatggcaaaactactgctgccttcagcacagagaggctttacctagaaaatggggggggaaatggaaacatggaaaaatgcattgattggaaatataccgaggacatgggaagttttaagggtgatgagcttgaggcgaggaaaccagatttgtacagttttggaagaaacatgcaaagtttaaattcggctggggatcagaggcagttattttatggcaaagatgagattggttttgtccagcttggcctcatttgtacctctccattttagctatagtcacatcttattaatacttacctcactctttggagcttaggcagaaaatccattatttatggttgagtattcaccatttatgtgtaagtaaggacatctgtatgccattgaatatgtggttgtgaagtaattaaaacagtttacagtgtaaaatgaaagacatttctctattttaaacatgcaatagagaaatggcattttatatattgtttagaaagatttatttatttatttaatgtatgtgggtacacactgtagctgtacagatggttgtgagccttcatctggttgttgggaattgaatttaggacctctgctcgctccagccaaccccatttgctctggttggccccacttgctccatcccaaagatttatctattattataaataagtacactgtagctgtcttcagacacaccagaagagggcgtcagatctcattatggatggttgtgagccaccatgtggttgctgggatttgaacttaggaccttcggatgagcagtcagtgctcttacctgctgagtgctgagtcatctcaccagcattttatattctaactagattcaatagacacttttgttttgttttgttttgtttgttttttgtttgtgatgaagaatactaaggggtttttacttagttagcagtaagcaagatgaactgaatatattgtatcaagaggcatcgagattgcatggctgtaactcaggtggtgatgaaggaggataaccatcccctggaggctaacctgagctacacagcaagacccaacccaaaagcagccagccaaccaaaccaaactcaaacccaaaggcccgtgaaaaattgaattctgatgattagtgccccataaggaccttatggaacatgaaaacaataggaagaacaaagagaacgagcaggtcagaaccacacttacccaaattaaagtctcccagcttggaagatcaaatcatacattacctcaagtaactcatatttgtctgcaaggtgtcagctgaccccttttctttaatatctcacttcccacccccacccccttttaaacagaaagacctttgattgtggtggccaataatttgaagttttgaagaattaattggccctattatacatgaagacatagtaatcccccttcacttttggaagcctcggagagagtttgagaatttcaagttgaaatatcaccccctttcacaaaattctgtatttaaggatagtatttttcagaatttaaaaaaattttttactggaaacttaatattacagcattccccttcagggtttatggtcaagcttttttaaatatatgttttatttctttaactggcagatgtttgaaagatgagagtaggattaatcctcatattaatttttaaatacatctcattcttccaaagaatgccgagaaaaagaaccaactctccatgtagtaactggcaaggaaggaaatagggctcctaccatggcaactccctgtcagggatgcttagtgttgtttctgtccaggttcctcactgctgagaacaaatagccaacaatactgagagacggggaggtttcttctggctaacagtttcagggatacagttattgcaggagaggagaggagaggagaggagaggagaggagaggagaggagaggagaggagaggagaggagaggagaggagaggagaggaggcagctggttaaaccgggtctgcagtcaggaagcaggggagccacacataaatgccgagactacacttgctttttccttttgctccactgtgagaacacagcagacctcaaaacacagcagtttgggaaccaacacacacgtctctttgtgtctggcaattgatgtaagctccatggtttttgctttttttctagctcctttaattgattgattgattgattgattgattgattgatttctgagactggattttgctctgtaagccaggcttgtgtagaactccaattttggctggcctggaattggagaagttcatattctcattatacagagtgcttaatggcaccgttatgctcaggtcattcattcattcattcattcattcatgcatgcatgcatgcatgcatgcatgagataggagttttctgtgtagctcagaatttccctccaacttcaaattctccttcctcagctttcctggcaatgaaaatacaggcctgcgccattatgcgcaagttatattggctgttgttaatatttatgttaggaaaagaaaatagtctctgttttacatacaatctacttggaatcattttttttttttaaagttaagtcggggtgaggggtgtgtgcaggttaacaagcaaacgcaattcctccagctaacgccaaggggcaccctctccttcccctcggtttctggagcgccttgagttctttccatctgcacaaagagcccggcctcctcccgggtgacatcacaaagggtcgttctccgccccttcggcgccaccacgtgtgtccccgagctgagtggccatccgactcagtccctcgccggccggtctaggcagcggaggaggcgagtgcttgatagtggctggaagcttcgctatgggaagtcgctctttagcactgtcgcggctagccctgctctctggttctccgcagccgctgtcgttggagagcaccgggaggcgcgggttgcgagcgcgcctgcttctcaccgcccgggcgccagcgcccctgggcaggtgctgagcgcctttcggagcctcccctgctgcctccctcttccgcctgggtgcctggctgctgcagtgcacatgggctgctggaggtagatgggctcaccgcccgtgaggcggcggtggatgcggcgctgggcagaaacagccaccaattccagctgccgtggggccgagcgccccgggcgccgctgcgagccccgagctcggccatggggacccgggcaagcagcatcaccgccctcgcctcttgcagccgcaccgccggccaagtcggagccacgatggtcgccggctctcttctcctggtgagcgataggaggggaccctagggtggcggctacgttcgagcctgtgtccgggagccgggcgggtcctcgggcccgtagtgccggaggcgcgcggtgggaccagacgggttggaagggttggttacaaggcaatagccagaccgaggaggactcctactagatcgtgtgtgtgtgtgtgtgtgtgtgtgtgtgtgtgtgtgtgtgtgtggtgagctaaggctagtgagtgttaaagaattatttttcttgcaatctggctgcttgaaggaggcgcgagaggtgtccgcctcgaggtcctgcgcatttttgggtttttgcccccgactcggcctatctcgcaccccaacacccagcctcaccccaatatcattcgctgccagaccctcggcgcggtgcgaggcccgagtagtcctgtcagtagccagctgccggttgtggccgctcctttgtcgctactgcaatgtcatgtccggatgctaccgcagtggagacagccggatcggtgcgctccggacgcgagcaaccgctgcatgcttccgcgcgcgaagctttccggagtagggcgcaggccaccccttgcttcagcttccttgcttctctcctccctcttagttcagatgggtcctgatttctgcaagccaaaagaagaagaagaagaaggagcccgggtgggtggtgggggtggggtgggagggggaggaggagaagaaggacccagagacccaggcgcctctaaagcacaggcttggagccaaccggcgctgtggctctcagtcgagggggaggggaaagagctacataaaggacgattaattttccccatccttttcttatttctccctttctgtgtttagacatgtcaccaagcaagatgatgcaggctctctcagcacccaaatctggggcgtgcccggattgcaatcctccatcactttatctgatcaaaacctgacatcatcccttatccaaaacttacccccagctggccctttatttccaatattggggccaagtggggaattaggtggaagaaaatttgaattcaaacccttgagatgctataaaccaatcatgtctttcatccctgcagggaggatgaaggttgttagctaaaaactaaacaaaaacaaaaaagagcttgttttcatggttgggctgtgtaagggaaggcaggcctcttgtctccttcctctaaagggcttactgcctggccagccaagatctactgcttccatcccaaggcatgacagttgctatggcctgggaattcattctacagacattctggttctctctgtctctctctgtctctctctctggctgactctctttctgtgtgtgtgtgtgtgtgtgtgtgtgtgtgtgtgtgtgtgtgtgtgtgtgtgtgtgtgtgtttagggagagagagagagagagagagagagagagagagagagagagagagagagagggctaaagaaagtttgttgttcttagcatttatgaggtaaatctcagtgtcccttgagagacgcttttctgtctttttataacaatggcaaagtccaagccctttaaacaagtgtggatagtaaataatcagagagtctttgggaccgtggacttgaattgacagtcttagattgaacgagttcaaggaagcactgatcctaatgacctgagttaggtcccttgctgagttccctccaaaggtcttagacctgcttccgtgatgagcatatactgccgtgtgtccctgctccacacagatacaatccttatacaatacttatagatcagtccactcaaatccaatctaaagttagtgctcaatgtatagtcgtaatctggaattattttttaacttttagcctgatatataggtccttgaaggtctcagcatagtaaaaccatatgctttaagtaaccaagaaagggcctagttctttttattaaatgatcaaactcaatgtacccacagattgcacccagatttgcaactgatgacctacagtataagtttgacagtttgatgaagtttatgaaaggtattttagagacaatctcaaggtgacgatgctacagggttccttgatttcctggtaactatggcaaaagggctttctttaaattgatggagtaggaggagggtgagctgaccatcctggagtgtgggaatactccaggaaacatcaggagctatgcaatgaccttctccatccccactttggacggtccagtcatcaggacgggccctgtttctgtatacaacagtgatctggtgactctgttctcaggagaattggtcccattggtaatcttggccacattaacagcagacaccaggtaggacagctcaagtaaacatggtgtgaggtacctagaagaataatgggggatacaggaaggttaatgctatgtatatacagggtggttagataaagaaataatgatggcttccaattgcccttctctcatttttttttcatagcagtctttgttgttttttgtggctcttttttttttctatcagcatgaagagcttactataggctctgatatgtatgcctatcatatgaacttgtcaaaagagcagcgagctaatttatacagaatatgccactatccctgtcaaacgggtgtcacctccattctacggatgagaaaatagtctccaagaatcttactggtctgttgtagtatgtggtgactctgggctggaactccttggctcctactctctctcacccacgtaccacactgcccgtttcacaacttcaagttgtttggtgagtgtaaggacagagaaggactgctggcaggtagctgagacggtggcttgattaattggggaatataagtgagacgttcacaaggacctttggagtgagtcagtctagttgctggcatttctattgctgatgtgttgatgtgaccgtgtcatgtttggaagttactcacaaactgaaatgcagcatacacgttccaggccaaagttctgtaaatgagacatttagatctgtagtggtttagggattgtcctagaaggacttgcttactgcaatgctggatgcagtcagaggtgcctcttgcctttagggagcttggtttgactatacagatagactgattgcaagggatggtcaagggaggaaagcaacttccttggtaaagactttggatttggagctttggaaactgctgttatccacggactgagaattcctgcactgaaggcacagggaagaaggcatagcagaagaaggagtggaaagattctaaaagccagaggaacagaagttgctgtgagatcgtgtcacctggaaatgtccgggaagcttcactcatgaagtttcaacagcatggctgcgtaagcgggatctgatcagagaacaccagtggacaggctaacacagaagggggaacttcatagggcctcagccctagacaaaaaattagaaatatgggctactaaggaatatatatgtgtgtgtacaatacgtgcatatatatacaaacatatgcacacacacatatatgtatgtgaatgtaacacatgtgcatatgtattatgcacatgtgcacatatgtaatagcaattgaaaataacgccatgaatttgagtcgtgcaaggctggtacatgagaggttggctgtcgagaggaaagggaaggaagaaaagatttccacacaagaggttgtccagctgtctggccatcccttttctaggcagctggcatctcaccatttctggtcaccaaaagaaaaaataccttatttatttatttatttatttttcttttgccggtgggaaatggtcagacacatcatcagacacatcatcagacacatcatcttgcttagagggtcccaagtgttactgttggccactgctcctgagttctaccttctgacttccaactatcacagaaaatggctatctgcctgggcaggagtgtacatgtgaggtcatctggggtggggtggggcactcaagtcctagccttggtgacaaatccaattagaatatgaaatcagagctggcgggcatacagagggctctctccctttgatatactttaacacagcatcctagactgtggaagctgggagggaagctaagctgttactgatctaacaccccacacagcttggctgagggaaagaacagcctccactgcggaagtgactatttttcattttaccaaatctacatggtgcagaggcgggatcctaagcagtggaagcccagtgatgaagtgggattagaaccttgcgtggcatgaagctcatttctgtggcttataaaacaagtggccggtgtcaatggatcaatgggtgagcatgctagaccccgagagagacacagatgtgatgttcacatcttcaaaatatgtagtctgtcagaggaggaaaacacttctattttggaaaactttccaatcttggaatgatatatgctagttgatttatgggaaattgttaatgaggaggaacaagtaatccagatcttctactggattgaacaactcctgatttttaacccataagttatccccacaaagtttagagtagggtcaagctttctcatttggacttactgtatatctctggctatcagatttagtcacagacagacagacagatagacagatagacagagtctccaggacaactaagcaattaagatgaatctacaagaaaaacctctgtagttacacgggcacaggtccactgactacttatacatctggacaatgtctaccaattagataaagcaaccatagtttgccttccccagtggtcaggggtgggtttggcttcagagctgggtctagtgagtagctggtgtcttctctttggaatttggggacatcacatcttgacttttgcacttgactccatcttgaggagaggcaaagcttcttgggaggcttggtagaaaagctgcaaattggctctgtgctaactcagccagcaggcaaactataattggcttacataaagttcacgattattattattatttttttttcttttggtgacgggaaacggtgagatgcatcatcagactattcaagggccaggacgaattgagcgacttttccttgcgtaaacagctctgcctattttccagaaagcactaatactctgttggcttgcttcccccctgcacaggcctggcaaattgcggtaatgccaggtcaccaccagcaacttcttggcaatctcaggtgcttctcttctgtgactagaagggcccagattaactggtgggtatccggtggtcatttggagttgagtccatttggagcacgagatgcagatatattggatggacagaatgacaactgaagccattagtaggagcagcttggcccactgagtgtcagcaggaggctggacttggttgtttctgcattagaggccactgagttgtgttctttaggaatagaggcgagagatggtggataaacactggctttctccagtgtttatatttgtcaaatacctaaaaatcaacaggatcttaaattggcttgaaggctgccacctggttggacagtgattattaacctggagggagactggcagatgatcagaaatatgggtggggcctctgcttatggagagaggttttgatgaccgtgctgttgacagaaggcagatgcgcaatcaacattcatgaagagtgctgaagtcggggtcgtgtgtgtcctggttggaggcaacatgtctatagtgttaggaaagttgtgctcagggggctctcaggaaggtgtgggatgcagcaggacctcggtaagctggcaggatgctgccccatgtcctttgatcttctcttcagaatggttgcagactatgcatgactcgtcgcaggtctaagacaaataaaaagaattggagagaagcacatagccaaatcagaacacggctagtagagctatgagacaggcctatatcgtgttccattcgctctctgcaaccaggatcactgtagtggctctgttgcttggcaccatttgcaaaatctgcttggagggaagaggaacacaggcttaatagagttagacaagaacatggagcttgtccatgtgccctggcctcaagagagcagctgtgaaatcagcagagctcctgtgttagtggcctttggaggaggactaagcaaatggctgctaaccctttatattgggatgttatttaatttatatattataaaaatattatgtaatatattcattcatatactatagaaatggttcttattactgcattgaatatcttctgtaaagcactacagtgtacattttacaagtcccagacatgacagctttagtcccattttacagaatccagaataaggtttgatagagtttttgctcagatatctgcccattattacgttctggagagagggatgaaatctagctcagcatagtttcaaacacttagctctctctgccaagagagaatggaacaagtgaacagaatggttcacttcaacttcccatacatacgtttgtttattctaaagggaatggttttacccaagaggtgaacatgcccgttttattctctgagtttcacagtggtacctgaatggtttgccaaaactactggtacttgtgagcatggtgtgtgggagctgaaaggggagggcgtggagacattgggcgaacactttcctatggtgtgactctgacgagccatggtgccacggttgagatggaaagacaccccagcaaattgaaactttataaatagggaacgggcgtgttggctctcctgcagccctgggtcactttgaaaaatatttgcttaatgagtaacagcgaggtgtgggctccactctgctgtgtagttagtttctgctcctttagtctgagcacctgaggacctgctagggtctttgctgctagcctgactctttgtataggataatagctgtaccagcaatgactagcatctgtccacatttcattccggttctcattccatggtttgagtggttcgtgctaggaatgtagtggataggttgccacagttactggagcaccctcataaacaagccgttagagaaaaaaggagagagcttcatacatgcataggatacgttttgatcaaatccacagcccttcactctctctctcccctttcaacttctcccaacagccccctctccccatcacctttccctcccaatttcacgtgctctttctctaaatccactaagtccgtgcacctgtaggtacgtgagtgtaggactatctactgccgcatggatagcctgtcaggagccccatccccaaagaaaatggagtcttcctccccgaacagccatcaattcctaacggcttctcagctaggggtaagaatttatgactccatctcctgcccacgcaggcttttgactggcttggttttatacaggtcttgtgcatgcagtcccaaccatgcacacttcatgtgtgcagggccctggcatttctagcaaatactgtttcactctaatcaaatgatccttttggatcttacaagttttctcctcttctttgagatccctgagccttgtgggggaggggctgagatgcatcggtctcattttgcacctaacactccaaggtattctaggtattctattctctgtccgttgaccaggcgtaggtctctctctctctctttttttttttttttgattcccatcttctacactgttggaaggggagggagctatgctgattaaatgagctttgagatctgttgaaatcccaatttgtagccttagcagacaaaagctggaaggaaatgatgtattagtgccagaaaagagattggagttctggtctcccaaaaacctttatgacaagaccactgtctgatttcactgcagacatggctagctagctctgctcagcaaggactcagagaggcagcggggtacgaacgagacaaggaaacttgcaggcaaagatgacaggttttcagaacagtccaacttgtatgtttgtgcttattttggccccacttttctttccataattatttccctttctcctacaggggtatatttgtgtttttcatcaacttactaaagcgtaaagactatctactaaggaacaggcatggctagggtgtgggtctatagaagtgactacaggttatctgtagtctccccttggagttcgcagaaaacgtgatgtttcatggtaatcatcataaagcagaagggagtggatttcagtggaagggaccggtatgtagaatagccccagtgtaggacagagtctgtgtcttcatctctgaccactatgactgggaagaggcagtgggactgtgtgtcgtgggacccttgaaactatgaagattcgttcagtgcaggagaagcagggtaataacatggcttgaaacattctttttttttaaaccttatgtatctccagatctcacatctccagaaagttcctggcagtcttgagacactaatatgggttctgggaaccaaatgcaggcctctggaagaacagcaagtgcttaaccactgagcatcactcccacctgccaacattgaaaaaagaagttttaattaatccttagagaattccatttagtgtattttgattccattgctcctgaagctcctcccagatcctccccaccgcttaacttacccaagtttctctccctctcgcgcctccttgcattgagtatagtttgtgttggctaactgcttttgggtatcaggccacaatcaataaggaaaaaacaaaacaaaacaaacaaacaaacctgtttctcatactgaggatggaacctagggttttcacatattgagcaagtgctctaccactgagctgtactcagctctcagatcgctccagaagcctgctggaggatggaagctggaggtcagctgctttcacagggtggagatcacagtgccggggatagtggcggtgaagatgaattttctagaatttactggtggtaagatgggagggggtcaggtggtctcaaaggaggcggactcctaggtgcctaaattgaagtctgtgattggaaggatgggctgggggcgtggcgggtagaattagaaccctaagcttctgctgtgtagtgagttaagtttgaagtgtcggcgatgaacattggcttgggccttgattttgccattttgaaatagctgactctctgcaggtccgaagcgcactgagccatcgcgactgtcgccaggcatttgggctgccgtccttcctccgcagcatccagcagcacagacatctgtgtgtagagcaatgctctgttcccccttaaggttgcttcctctgattgcattccccaaagtggcattgccaggtcagaggaaacgaatgagtggtttttatggcgttcgctgcagattgccagattgttttttaggaagacaatcaattcagccaccagccacctataaatgtgctttctagtccatgaatctgccgcgacgggactttctcatttcaaattacgtatcttctttttaattcagcgatgtaaggacctttggtggtctctgtgacagtttagtcatttctaggggcataataaacttacttgcatgatgcttgacttttaatgactcatggtccttctagcgagtagaagttatgctaatcttatttttatcaattctacttatcattctggttataggttcttactagctgtaatggcattgctttatattctattgactttttacgatcatgtttacgtatttgctttgtttgtgtgcacgtgggcatctctgtgtcacagtgcatggaggtcagagacaatttatggagtctgtgggtcctggggatagaattctctacctgtcaggcttagtgttaagccccattgcccactgatccattgcaccaatactgcaccactactgtactctactataatatcatgaaaaaaataggattgtgttattaaaccttttcctttctgggtctgagaatattctttttgttttgttttttggatttttttttttttttttttttttttttttttgcccattttgttaggaattcatcctttgacaggtagttataaagaatcctaattgctttgaattttataatgttattggttgacttgttgatatttctggatattggtgtcgtatatgtggtgggaatccccttggtgtgttctgaaggctatatgtgcgtgtgtgtgtgtgtgtgtgtgtgtgtgtgtgtgtgtgtgtaatggattctgtgggtaaacacacaggggagtgctgggcccagctgattcaccatttcaggctgttcttccgtggagtcacctgggacaggtgatagctgatatattaattgtacccgttcaggagaagatatacggagtattttctgaactctagactagggcatcagagactttttctgtaaagtgctgggcagtacggttatcttatgatatctgtggtaactacttaattccacctttgtgcaagacatgtgcagacaatgtctcgaagagtgagtctggctgtgtttcaataacactttatttgtggataatgaaatttgagtttcacacagttttcactggtgctatattgctactcattcattcctcctcatttcccagctgtcagactataaaactgttgtaggcctgcctataggctatacaaaaatagacggcgatagagtccagcctgcttttagaccagggcattaatattgtgtgagagcaaattggggcaactcactttggaaaacccttacttaatcgtgttctgggcatctaaagtgagattattaattgtaaatcctttctattttattattattttttgttataagccaaggtttatttcattttaattaattaacttactttgaggtagtgtctctggttgactaggctgacccaaggctaaccttgaattgcctccgttttaagtgctgggattatggtgtgtgctggtctcggaactcaccaggcaggcgctcaaatagctgagccagccacatccccagaatcccaagtgtttgcttgtttgtttttaatatagtgtgaaaagtagccttgctttctcttgtctttatcttgacgtctgctttaaaacaaaacttctacagtgtgctctgtgttcggggaagtgagtttcaggattataattttttattttttaacagtattattattattattggtatttttgagacagagttgctctgtgtagccctggctgtcctggaactcactttgtagaccaggctggccctaaactcagaaatccgcctgcctctgcctcccaagtgctgggattaaaggcgtgcgccaccacgcctgcataatcttttattaaattaaataaaagaaataaccaatttttggtgtttgaggaagaatatccctatggaaatcagcttgaataggaaatcagtgtctagcacaagctggccttggattttgtgatgttcccgtctttccatcctaaattctgtggtcataagtatggaccaccatgtaaataggcaagtaccactagtacataggcatgcatccagatggcagttcttttcttatttgcttgttctgagccagtttgggtgtggatccctgcctcactttgaatacactatgtatatccatctggccttgaactcactaagtacaccaagctggctttgaactcactgcatacctcaagctggccctgaacttgggatattcctcatgcctttgttcccaaagtgctgggactacagtggatgccactgtgatggagttgggttacacctttaaacaaaaaagtctagagtttggaggctggaaatgtaacctgcctagcacacagacaaccttggacttaattgtagcatgacaaaacaaaacaaaacaaaacaaacaacaacaaaaacaaaacaaacagcaacaacaaaaacaaaacaaaacaaacagcaacaaaacaaaacaaaaaaggaaacatttctcaaatttatacttaaaatagaattgaaatgttttaaaacattgtctattcacaggtaataaacttaaagtctagtaaaataataaattggtggggtgataatttcccaaactggtattccatccagcaattaccatgtcagacatgttctccatactccttctgtgtagctaattatcaaaacaacttagaatggccgttgttattgctgtgtccattttacaagcgaggaggtagaggcttggacgttggctccttcccaggttagaaagatagaaaaaaaaaatgtaattttcttcagcttaggaaccagattcaccagctgacactcacagggtgtcttcaattcacacccgaccctatttgcttcaagatagctaccggttggaaggctagattccacaagacggactctaacggacgtcaggtatcaagagtaaaagtcaggttataacctgtgctttctgttgtctgactgtaagtcagagttcctatggctctcagggggttcagttaacttgtaagcatggcctcacatatctcagggaaacactttctgaatatggctctcttctacagaaaggagacccatgataaagcatgcagaggaaggcatgcttagggcagccatataaggagcaccgtggagctgtggagctactgtgtctgtctgccttggacaccgtgagctctctgaaccttgtcctttcagagttttatggagatgctatttcataggcacaatttactacgtcattagacactggtgactaaacttaaccttcaacccctctcctcatcccagagattgaggtagaactgaaagtagcaagctgaatataaaaaccttgtgtgttctgaccactggtctccatcttggtggcaccctctcagagcctccgtcccctgtcattttatcaccacccagaagaccctaatcacgctggctgtgagcttccctactttgtaggatccatgggaagagaccacatctatattccttattatcacaggatcgcggccagcagatacctgggcgagcagggcgtatgtggtacattctaggcttaaatggtttttccttatactttgaagcctcagttgctgcactggcctgggttgtatgctcttccagacatgcccagtcagcatgaagttgcatccttccatcatctactgttttctatgacatactatttcacttattactcactgggcatcctattggcatctctcagtaagcagagaataaagaaattactactgtgttggagggagacggggctgtggtccagtgactgattgctgtatgcactttctcttctgcattgcgggttccagagaaaacagctcctaggtgaaatcttccctgtttttttcctctccagtgtcccctgagcttgcctccttctgttcctacagtcagcacattctggctctggcattctctatagtcaccagcttgaaaaacagtccctgcttcctttgctttggcaataggagacggctctccctccttcccattcctctcatccctcccatcctcctcttccttcatctctccctctcttccatccttcctttcttccttcctctttccttcttttcagagaaggcagtagaaatgaaagagccaaccaagtttatataacataactggaaataccctgtctgtgatttgtggaacctttgtccttgaaacgtttgtttgtatgtatcccacctgccccacaacttcagatctggggaattatagccatccagtgtttatattacaaattaaaaatgatggcccagctatctggtcaacaattctgagggctgagcagctctgtctttgtcatcaggtatcatatttcatagtcatcctcataggcaaacctgattaccttacaatctctacagtaactacacacacacacacacacacacacacacacacacacacacacatatatgtatatacacacacacatacatgtgtgtgtgtgtgtgtgtgtgtatggaaaaattctatatcaaagtccagagcaattttcctgcttcttactaaggaaaagcaggtccacctctgtcttaagtttgctcgttttataatgaaatgttactagaacttgagaggaaatgaaagtaatgtctgcctggtgcagggacgatggctcagtgggtaagatgctggcttacaaatgtgaagagatttgagtttgaatccttagcactcatgtaaaaaggctggatgtggtcttgtgagcacctgtaaccccagcattatggaggctggagacaaggaggcttgctggagcttgctggctgccagtcttgttaaaatggcaagctccaggtttgatgagagagccctgtctcaagtcaacgaagtggagagcgatggagtaggacactctacatcctcctccggcttccccgtgggcatgtgcacctgtacacacacatgcatataccacacacacacacacacacacacacacacacacacacacacacacacacgctaacgtcaatggcacagatctgttgtaacctttaagctaccaagggatctcttgtttatctgaaggatgaggtaatggaagtggaattgctgaacaataagtagatgtctacattctgacatggattcacacatccgggtgcttcttgtcttcagtcaggcccacctgtgctgtaaactgcaagtgacacatcataggtgtgctataggccaccaggatgcacagtgagactctggaagccttcacagtcagtcacctgcaccaagtgctgctctccacttgatctctgcttctctcgtttaagcttctaatcattcaataaacacttgtagtgtttttggttgttgttgtttttaaccaaatacagtttgagacagcatgctgatacttgatgcatctatccactgttgtagttgacattcctttttttttttgattagatgttttctttatttagatttcaaatgctatccctaaagttccctataccctccctccgccctgtaggtgacattcttagatacatggaattttcataataatcgcagtttaaacacagagagaatctaaccttcttatattgcttataatcttaagcacaaagtgtaatcttctctttttttctttcttttaaatgagagaagaatatttgaactctttagtatattagctttttattttgagtatcacgaagaagctaattcttagaagccaattatagttctgttaagagagagtaatggggggctggagagaaggctcagaggttaagagcacaggctggccaggcatggtggcgcacgcctttaatcccaggacttgggaggcagaggcaggtggatctctgagttcgaggccagcctggtctacagagtgagttccaggacagccagggctacacagagaaaccctgttctgcattatagattccagggaagacacacagagtataagtgtgtaagtaagaaaacgatgacaaccatatagggaaaagaagaaaccgaggagggctttacaattggggatgggaggcagggagagcacccaggaggaagtcttgtctctctggatgattttgctttttctcagacgtcagggggaagtgagagtttgaagccgagtgtgaaggaaccagattgagcgtgtgagttagagtgggtggagagagagagagagagagagagaaagagagagagagagagagagagagagagcgagcactctgctcataaagaaacttatgggggagaccaggaagtttctatgagcagctggtctctgcaatgtttgtatttctttagatgcccatgctgggagctggcagatttcacctataaagggccaagtgataacagtaagctaactgaggtttctgggcagaatggtctctgtcatagctttgtcgctttcccacagtagcctgaaagcagccacgagtgctagctacatcagtgtctggactctaggaagcttgtttataagacgagctggtatgttggcattcctttgctggcccctggcttgaaggatggtttgcttattattttcctagtgttcattaggtagttgagcaagtgaggaagtatagtctgtacagtagtccctggccttgagctgcttataagcattaaggaaagataagtatatacacttacggtactgccaaccaacattaagagacactatgtaattagacgctggtacaatagacagaaacaggaagtgcgatgggctagttgctcatctgcttggcatctgggtgtttagaaagagatttaaaggctacataaggatggcaggatttgacagaatcacaacacgcaggagggtagaattggttgaatattactactgagttcaacctgctcatttcctaagtgagcaacccaggatcctgttgacttcccaacaggttgggtaagaacatgccttctcttttcaaaatctttgtccagttcttttcctgactttttctgcttgatccacccagggatgtttatgtacgtatgtttgtgtatatgttttatattgttaggggtgagagaatggggtcgctccaggttatcgattgcatttaggatgtcaaaagactgggaccagggtgatcgtgtctgctacttggactgatgtggagagaagagaagctaggtgaggggtatgggagggaagaagcagttgtgcacaatagaaaactataccctgacctatatacatgcaagaaagcagtcaatgaagtcttggtgggaagaccctctgaagtaagacatacccatcctgttggttgcgtgcctagcctttaatggctaagccagctctgtagaatatgctcattctgttgaagaactctgaattgttagagtgagacagtttgtatgttaaaacagacaggtcttggtgatgtaacagaagttagtaaaagagaaatcacagagcaacatggttggctttttttccctttgcatacacaaaaccaactcaaacaagagaacggggaagctgagaatctgtagttccaaattgctaggactattacatagatgtttattgagggggggtggaagtaaaatgctaatatcaagttatttaaaaatgccaggttaggtagagaagggggtgactctgactgtgagattgggttgtatccaaaatgtggctcaggatcaaagaattttacagtcagaggggtcttggtttagtgttagggactcaagagttagttagataccagaaacactcagattgattaaaaaggcaagaaaaaaaaaacctcacagccaaacaaaataagttcctcaccctgttgtatactcacaacgatctcagagataagacgaggtacatgaagaaagtactttcaaaaatcatctcagacagtattattttttctttttccattttcatgtgtgtgtgtgtgtgtttgcgtgtgtctgggctctcatgtgtggttccatgtgcacatggagccccaaggttgacattgggagccattctcaattgctcttccttcctatttggcgaggcaggtgcttaagccaaacccagagctcagtgatatgtgtcatctctctagcctgtttcttctagggatccgctgacacctctgtgatggaattacaggtagactgatgtatccacttgatacacactcttcccgggcaatttcagttttatactcaaaagccggaaactatgttagatctctctgacctgtcttagccatgtctatacacatggtgggggttgggagaggaatcaagggtcttaattggaaggacccagcctcggttttcttgactctcactatccatgaccttgtctcccctttcccatttgtttgtcttctcctctagggttagctttcactataatctttttatattgtgcaggggccatctttaaatattgtcttccatttggtctatttctgcccagatccatggggttagagggaagagctaatgtgtgaggtgcacatatgtgcatgtgtggatgtgcgtgcgtgcgtgcgtatatgtgtgtgaactatgtatgtatgtatgtatgtatgtagaggcatgttctcaggtagctcaagtgactctcaaacttgacgtgtagccaaagatagccttgaactcctgatcctcctacctcagcttctcaagtgttgggtttacaaacttgcgccatcacaaggggatattgttttgttttgggacaaagtttctttatgtagctcagactggtctggatcctgtgatcctcttgtctgagtctccctagtaccggcaagtacttccacaacttggaaggggaaactcttgtttagatacagtttttccttcttcttctttaaatagcacagtgggattagctattgactctggaattgggagagactttagaggaccctgtagtcttgtttgagtaataagctctgctctcaacaggccttccctctgattaggctttgcaaagcagagctgctctgtttgagacagaagtgagggggcttggagcctacctcccattgctccttggcaagaggcagccctgtgatttttgtccagttcagcgcttgcttcttgtcccactggtttcttcctccatccacttcgctaaacacagttaattcacactctcctttattctgtttgcaggagatagatgaggtaattttataggtcagcattatagtcccttaaaaactgataaaggagccaggcatggttgtgcaaactagcccagctccgtggctcatacctgtaatcccagcagcaactggagagtctgagtcaggatttccacgaggccagcctgggttataaaataagactctatctcaaaacaaaatatcttcaaaataattttacccccacgaaatcaagaatcccaaatggagcaagcatggtatagagtgtagggaatgtgcagttgctgggtggggtttgaacacagctaagtgaccccaacaagtcagacatcaggaaagaacctaccatccctgtcttagaacaaaagtctggacccttgtctagtctggtgggtgttgtcagcaatgtgcacactcagggtggctccctggatcaggagccctgggtggggaaggctggggttgaggctccatttcctagagctttgtgtatctccccagggtgcacacttttgagtctacagtgggggtggggcactaatcttgtactcgggctccattggacagatggtttcctccaccctgggcatctgctgaactccggatagggtgtctgggctggttgtgcaagtagagggagcaggaaaaggaagggccaagccaaacgctgagagaggagacttaccaccaagtagcaggatcttctctttctcaatttccaatatgaaattaaatttcccaacaagaaaaccaaccactatccatcgccaaccacctctgcccctactttcagactcagaaggaagaaaactaagtatatcgtaaactctaaggaggaaacctcaagaaccggtgagaggcggggaagtaccctggccccacataactgtggggttgggaaaagaatagactggggtcaagtttcgagatgctaagaagacagactcttgatcaccttgcaagcagttttttttctttttcttttgctttgttctttcagttaccgatgtagctgtaaatctgtaaatctagaaggaatttgttcggtagctggtagcttggggcagccatgattttcatacaaatttctccatctcactgaggatggcaaagactatcagggccttcattttgacagccccagggaagcagtcactctagtcttttgctccctgcttctctttcacagcatctcaggacttggaacttgggatacccccaggtgtgtgtgtgtgtgtgtgtgtgtgtgtgtgtgtgtgtgtgtgtgtgtgtgtggtttgtccagacagggtgtctccatgtagccctggctatcttagaactcaattggtagaccagactagctccaaactcagagatccgcctgcttctgcctcccaagtgctgggattaaaggcatatgctaccacacccaacgggtcctccaagtttttaatctggaagttggtgaaactctgacctgctgggtgaagtttttattttagaacatgaacactgagttattcttgctggacccaagctcaatgggtagatttctcaatggatgcctgcagggattgtgtctatcggttgtggccttcagagactggacaaactgcgtttgaatctaaaagcaccagctccattgtttaatgcacataacaggactgtcaaaagtatggctgtttgttaaaacaaaacaaaacaaaacaaaacaaaacaaaagtttatcatcaggtatgcaggtgctatagaaatgacaactttggcacacacctccctctttctgatgtcaagttggtgtggtacccgccagatcttgaacagtggtgatgacctgttattgctgttgctgttgctgttgctctgttcgcctctgctcctctatctgacacctctcttatttctttcagcttggattcctcagcaccatcacagcttggtacattctggtgccaagtgtggccattcccctggctatcgccttcctcttcttcttcatctgtgtgtgccgcaataaccagaagtcttcatcaggtaccgatttaaatgatccagtggtcctgcagaggagagattgggagaatcccggtgtgacacagctgaacagactagccgcccaccctccctttgcttcttggagaaacagtgaggaagctaggacagacagaccaagccagcaactcagatctttgaacggggagtggagatttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatctaagctctagataagtaatgatcataatcagccatatcacatctgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcccccggctagagtttaaacactagaactagtggatcccccgggctcgataactataacggtcctaaggtagcgaataacttcgtataatgtatgctatacgaagttatatgcatggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgtgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcccctagataacttcgtataatgtatgctatacgaagttatgctagccacaggggcactgcattctgggaatcaacctactggcggggtgatttcatttcgtttctgacttttgtgttttggtgtgtatgtatgtgtttaacagagtgtatggccggtgagtttgggttctttctttctttctttctttctttctttctttctttctttctttctttctttctttctttctttcttccttcctgaaagtgaatgtataaagcctttacaatgtataactgttggaaaatgcccaccactaaatttttttttaagttccacatattctccatttttgccttcttatatatatcttcaacactattctgtgcactttaaaaacttaacataaacgcagtgtgacttctcccatatgctgggtcccgagactctcaacttcttaaaaacctaatggcatcttgtgactcctagaagtagacataagtctttcaaccttcacacctactctttctgttttaattattattgctatttgtcttattgtttgtgctttacaagcgttcttgaggacggagggaatctacgaccctgttgatgactgtaactctattcgactttgagttgtcttcttcatgtcttgttatatagttcatattcatggctgaaacttgaccatactccctagcgctgattgtatggttttcgtctggacaccgtacactgcctgataacttgtgcacctcttaacgctactatgctctgggctggagaatgaaatctttaagtcaccaggacttgctgtttcagtggcttgacacctgggccaccaaagaactcgatcttcatcttttagggacacctctgctgcaccttggaaagccaaccttaagtgccagtggcactttatgcccagctttgctttgaaagatatctttcttgttttttttatccttctctttctctcttttttttaaaaatacacatagtcaataggtccagtctgccctcaaggccttgctgggttttcttcatcatccaatcactttcattaaaaatggctgcagctgtaagaactcttgtctgataaattttcaactatgctctcatttatctacctgccctctgatgctcagtcgtcagactctaatgcaaaggtggacgtcggctgcctttgcgtgggcgggcttagtggtgaggaactgatatcagaaaaaaaatgccttcaagtatactaatttattaataaatattaggtgtttgttacttgtgtggttttggtatatttactactgaactttcgcctttccctctgctcaggttctagccctgttcatctcttggggaaggatgtgtgttctgaaacccttctcctgtccaatctgtaaatcatgaatattattagcaaaagtcccttttggagaggtacttggaggttcactgcacagggctctgataagcactgccaagcctttcctagtctttcggagttaaaccttaggtaacttgatacctgtaggacgatctgcacacattcacaggcttctagccaaaacctcactgtccctgacgaactccagagggcttggtcagcagtgaggcggatgtggtcctgtgttggtgggatatctcaagctcactgcaggttttcctaagcttggaccccacctctgcggaattccaatgatcaaacgctagcaactttaacatcctctttttgtgagaacctggaagctgatactgtgtatactgtgaccccccacgtcaacaactgggactgtcttccggtttcactcatctctgtgtggcagctttcaagatgaacatccttgtttcccttccctcttgttggtgcatgcctttagtccattggaagagagaggcaggaggatctttgattttgaagctagcctgggagtttcaggacagcctggctacgctaactaaaaaaaaaaaaaaaaaaaaaaaaaaagatcacacatgcgcacacacgaacacacacatacagagcaacaagaacaaacaagaatgggtcagttatgatgggggaggaaacaggttttgtcaggttctcactgtgtcagaagatttagaactgagacatacaatccattcattaattactagtatgttaagtttatagtttattagtaatttgggaattttttattaataacccaaatttgtggttttatattttacaacatataaagtttaattactttattggatctttaaatttgtcttaacgggttcctattattatgcccattttacagatgaaattgggcttgtaaagctaagtatatgagatggtttcttatcactagaacagagtccctgaaaaggaagaaaagaaattctttaagggaggaaacgttgatcttaactcatggtttccaaggctttaagtccatggttggctggctctgttgcctttggttgatggtaaagcagaaacctggtaagaaaacacgacggtggaaggttgcttacctcctttcggccagcaagcagagagacacaggaagagtcttgggacaggataactcttcagtggcacaggtccagtgaccttctactagctagaaccccctccctaccttatagtctattcagctatgaacacatccatggtcgaatataccactagctgaagcccaaacctccaatagatgagcctttgtgggggacacttaatatccgaagcataaaaccaaggaatgtgtttaagccctcactgagaaggttagcaaggctaggtttgaatccgtgttgtgtatgttttgggaagaagggtagagcgagtggctgtaatctaagactgttcattctctttataagatcactgaccagaaacctgttgccacctgaaacagtgggcagaaacatggcagtgaaatctgtctgggtcatgagtaaagttcaaatgcaagttaagtaagtggtacaaacgtaggcatgagaactaaacattagcattatatggtgatcccatgatgcatagctttcccagaaggcaatgcaccatcagctactttcttaaagtacccagagtcaagtgtgatggatggcacacacctggaacccagcactcacttgcaggctggaagaccaaggccttagggtcagcctggggagagggctcagtcagtaaaccatttgccacacaagcctgagaacctttggatacctggcacagcaaagtacagggctctgtggtgcacacctacagtctccgtgttgggcagacagagacaggaagatccctggggcttgctggctggccagtctagctgaactggcaagcaccaggctcaggcaagtcactccatctcaaaaaaataaggtgtaaaatggtggaagaaggcatccaatgtccaactgcagcctctgcatatgtatgcacaaggtcatacacacacaaacacagaggaggaggaggacgaggaggaagagaaggaagaggagggattcaacgttagcctgggctacatagtaagaccctgtctcaaaacagccatatagctattggagttatagttcattgacatttgatcaacaacactgcagaaactgggtgtgacattgcatatctcccaattctttcactccagaggtgaaggcaggaaagataaaaagttcaaaatcatctttgggtgtatagcaagttggagaccagcctgggacacattagatgctgtaaaaaaaaacaaaccaaacaactgaaataaaacaaaaattcagcataaaatactaaaatatgtgactttctgattaaagctaatgatagcaccatttgtaccatagaaaggtcttctctggcttgcgcttcttcctctgaggagtatagacagctgaaaaggaaggctgctagtgtgagggcagaggagacaagagagcaaccagaagaataagaaacagaagcaactgttgggagatccaagccatgttatgcaggcaggcaggagaaggagtctgttcaccaatttgaaggactaagaaggagtttgtgacccctgggaaaagactacagactcgatccaattataatgaaaagatttgttgattagctgctagctggatgagtaatctctgagccaacttcgagattacttcgcagaagggttacggggaaggactttaaaaggagaatatcacacaaagaccttcaatatctaggcaagcaagtaacaactgttctattttgacaaattaagtgattgaggcgactcaaaacaatcttgggttatctgtgcaacaagttacagaggcaaaaaaaaaaagttagtcataacaagtgttatgtatggggaggaaggtgtgactgagtcagggttattggaaatttatcttccggggaatggagttagagactagtgggtatggaaatgaatgcctagcataaaacggagcttctttcattttcttcagagagtaatatagttcctgtgggctgttttaggctgaactcaattagatagggctgcttttcaaggagaaactgcttcaaggagaggaaggagctgggcgagcatctgtggttctccaactttcatgtaaataagtcacccgggagtgagcagcttgttctctttaaaaaaggctgattcccacaatctgattggagaggtttgtggtgaaattcaaaaatgaagcccttgcaggtttttggaccacacttagaaaactatctttagagaatttccgttcctgccaatggggacaagaacagctaagaggagctggttagactcgcaccttcagaggcctcctgtctacccttttaatgtgcaaatgagatacctgaaggtcctgctcacaggcagactctccaggcctcttctgggaaagggcagctggcatcctgtgttgctgccaagctcttgggtaatacaggcactgctgggtttttctttttccccgtgaaactgggtagtctgggatgactttacctttcaggaaaggggcagaacaaacacaggagtcgatcactcatttcacaggagggaaggaaacacactttgatgagctgaagaaacacccagaaccaagcaaatctggtcaaaacttacaactggttggggctgggcttggtaaaagtgcctgcagcagaagcacggggacaggagttcggatcctcagcatccatgttagaaaataaggtaggtgcagtgctgcatgccccatgcatgctcccagtgctggggaggcagggacagcagaatcccaggggtttgttggcttgctagctccagggtccatgagagtctgtgcctaaatgataataaggtagaaaggtgatcaagaaagacatagaactttgggcacacaaagcctacccctcctccagcaggattgtataacagcagcagaaagaaaggagacttacagaaagaaaggagactcctcgaagcccaactatttggcatttgtgcagagagctctagggatgtagctttcaagggtggacttcttcacgagcagttgtatttgggttactcatacttctgtaagtaactgcaagaaattcatctggacgcaagaagcatcatttctttgttccgttggcagtgccctatctgaggcaaatagacatttgctgtgtctctccaggaaaagtcacacaatacacagtgaggctgcctggcagaggaatcctgtttatcttgtggtcaaccagaataaaagagacaagaaaggccagagtctcagtataccctagaagaatatttccccaggtaatcaacttccctccattaggctgcacctcttaaagtgtctgctacttctaaatagtaaactggtcacaaagattagacacatgtcctttgggactcacttctgaactgtacccctgggctatgaattggtcactttcctgctgttatgacaaaatatcaccactcaagacaatctaaggaaaaagaatttgagcttccacttttggtgagagagtccataaagacagggaagagatggcagctggaacaggaagctaagcctcaatcaagaagctgagaaagtgagctgggagtagtgaggctatataacatttcaaagtgatctgcctcctccagcaaggttgtacctcctcatcaaacagtactacctacttggtcccatcttggttgcttttctactgctgtgaagatcatgaccaaggcagcttataaaaaaggaagcatttaattgatcaatttataaacactttataggggactggaaaggtggcttagtggttaagagtactggctgttcctcttctagaggttctgagttcaattcccagcaccccatggcagctcacaaccatgtataatgggatctgataacttcttttggcctgaaggcattcatgaagacagagccctcatatacattaaataaattttatgaacagcttataaaaacgttataaaacataatttcagagttaccctatgactactatggcaggaagcatggtggtggcaggcaggcatagccatggagcagtagctgagtgcttacatcatgcctgaaagatgttgacagagtgagacagggcttttaaaaacaaaaaccacgttccctgttatgcacctcctacaacagggccacacctcctaatccttccccaaacagttccaccaattagagatcaagaattcaaacatgcaaatcatgctcattcaaaccaccacagagcctacaaggctctcattcaaagcaccacaagacagcaagacctatatgaatcagacctgaggtgatggctgtagcttcctgagaaagggtttggggaatctttccaaggagccagctttgctctgtcccttacaagtagctgtctccccagctctctaggatcttcctagagattagattaggatttctcccaaacaaacacaaaaaaagtccaaatggagagggttcaaactcaacatttaaaaaaagtgagtcacagtaattatgttggggctcaaatatctatttcttaggatagaaatctctcatatttaaggtctttgggaggagaaacatgaaaaatttctggagttgtcatgcatacacacatacacatacacactatatatatatatgtgtgtgtgtgtatacacatatatacacacacatatatgtatatacacacatatgtctatatgtatatatacatacatatatacacacacatatatgtatatacacacatatgtctatatgtatatatacatacatatatacacacacatatatgtatatacacacatatctatatgtatatatacatatatacacatataatatttaaatatgttttatatatttatatattatacataaatatgcttaagtattatctatttaaatatatatttaatatttaaaacatatattataccacacgcagtcctctaaccctccattggagatgtgcctgttccgtgttagttagcattctcctactcagtcaccctctgcttcatccactgcataatgtcaaatgggagatctcacagagaaagaacatgggacagcaagttcattttcaagatcacatgacagttatttccataagtatagacacgtggatttcacatctcgtttcgtccatttgtttgaatgcagcatacctgtaggacggtgaaaggcagcctggttcctggttgagctaaggctagaaaccctactgaccctaaagggatgcttggagtttgcctggttcttaggtaccaggcttcatgcacgaggccacagccctccatagatttgtggccgtcagtaacgtaagggcaacaccgcaagccaaagcccccccccccacctgccacacacacacaggtagaggacgtgacccatggtcacctagcctcaagacacatctctattttaatgaggtacctaaaggcctggaggacttagccaataaactctccttcccagatgttccttcctgcaaaaaaggtatttaacttcaggccctccctgagaagtggggtacggttttactcagccacctttcaccattacaataaatgccttaaaatcatggattgctacttttcaccgggatctgctatggagaagaccttctttgcctacagagctaccatctaatttcttgtagaagacctctctgctctcccagccatggctgccaccaagctcaagcttgctgccacagacagccagagctcctcttttttccccctcagccctgggctagattcagcccgctggcccccactctgttctcaggtcttttgtggctctcagtatgcctgggtgtccaagagcccgagaaccagacagctagggcctccttgtaggccgggggacccccaagccagttctggctgtcctgggatctcagactgtgctttcccattctggaagggttattccatggctccccatagaccaacaccagcccggtgacagtgtggggtaagctctgtcaaaactccagcgttctgtctccccaagtagctgtgctctgtggtgggcacccctacacacacccatccacagaaacacagatgagttcttccacttagtctgagacatctgaacagctactaggttctgggctaggggctagacgtggggagaatttgatggagcgttgaaactgctgatgaggaaagagaagctctctgttcacggctctgtcctggacatccagagcaaagtatagaaatgtacttatgctataggctgaataactgagtgaatgcaagctcctgactgcaagaagttcccaacatagcaagagacacgaagagagacattcttataacaatggtaagtgatgagaaatatggaaacagtaattaattatatccaagcataatggttacattccatagaagcatttgaagacccagacaccaaatacaactcaaagaaaagtgatataaaattttctagtgtaagcctagtaatttcaatgataagttgcatcaaaagtcaggaactgatcaatgcgattctatcctcttcagagctttgaccacgataagaaatagcttgatgccagcttaacattagactctaaagcagtgaccttcctagtgctgtgaccctttaaaacagttcctcgtgttaggctgacccccagccataaaattacttcgctgctaattcataactgtagttttgctactgttataaatcataaggtaaatattgatatgcaaccctccagaggggtcgtgacccccacgggttgagaaccagtgctctaaagtgaactgcaggtgtgctgtgggctctaccacataaacaaggatgccatagcttttctactgttgttgttccccgtttccaggcttatcattaaccatcatcaggagatacgaggcccaggcatgtgacagcttagcagaagacaggccaagtgcaaccttgtgtggagctcattctctgagcaaatgttcaaaggctctgggggtgctcattgctcagtctcactttgaagcctgtactataggaacaggcattatttccactctgttgataaggaatctgagacatgcattgtgatggccccagtattatacagctagcaaagggtggagggagccaggaaggacatttgtagagctgagtgactcaaggtcataaaatggcaagtggcaagtggcaagtgaggtgacttgactcatacctgcctggaaccttttgtcttgactcaaccaaactcctccttattgattttttaaaaaaggtatctttttaaaaaatgtatgtgcatgttgcactggctggttctgtgtggcttgagttatcatagagaaagatgcctcccttgaagaaatgcctccatgagatccagctgtaaggcattttctcaattagtgattaagggtgggagggcccactgtgggtggtgccatccctgggctggtagtcctggattctattagaaagaaaggcaggggagcaagccagtaagcagcacccttccatggcatcagctcctgcttcctgacctgcttgagttccagtcctgacttcttttgctgatgaacagtaatgtggacatggaagctgaataaaccctttcctccccaacttgcttgttggtcctgatgtttgtgcaggaatagaaaccctgactaagacaaacgtgtctgtacccgcatgtgtttatgcttaccatgtgcttgcaggagcccatagagaacagaagagagcttctcaagcgatcctcggaaactatgagctgtctgtgggtgctgaaaactgaacccccatcttccataagagcaataagcattcttaactaccagacaatgcctccagccctttcttttttttttttattacgtattttcctcaattacatttccaatgctatcccaaaagtcccccattcccctacccacccatttccactttttggccctggcgttcccctgtactggggcatataaagtttgcgtgtccaatgggcctctctttccagtgatggccgactaggacatcttttgatacatatgcagctagagtcaagaactccggggtactggttagtccataatgttgttgcacctacagggttgcagatctctttagctccttggatactttctctagctcctccattgggggccctgtgatccatccaatagctgactgtgagcatccacttatgtgtttgctaggccccggcatagtctcacaagagacagctataacagggtcctttccgcaaacgcttgctagtgtatgcaatggtgtcatcgtttggaggctaattatgggatggatccctggatatggcagtctctagatggccgatccttttgtcttagctccaaactttgtctctgtaactccttccatgggtgattgtttccaattctaagaagggacaaagtgtccacactttggtctttgttcttcttcagtttcatgtgttttgcaaattgtatcttatatctcaggtatactaagtttctgggctaatatccacttatcagtgagtacatatcatttgagttcttttgtgattgtgttacctcactcaggatgatgccctccaggtccaaccatttgcctaggaatttcataaattcattccttttaatagctgagtagtactccattgtgtaaatgtaccacattttttgtatccattcctctgttgagggacatctgggttctttccagcctccagccctttcttaatcactggactatctctccaatccttccttattgacatatgtttaaaatgtaaagtatttttgttatgtgtgtatgcaaatgaatgtgctacaaaaaggatgtggacaacattgaagaattggttctttacccacccaaggatcaatcccaggctgtcattgactgggcttgctggccacttagtaaaaaaaaatattacatttggtaggaaggctggctatcctcggtctaatgaacttcctgacccaaccatcccagtgatatattatagacatacatcaccatgtctgacattgatagttggattattttttttaattttgaaataagttataacacattaagtttaacaatactataacgttcacattttcttttccaccagtttcccccaagtaagttagccttagacataatcaaaaccaggagattgacattattatattaccaagcaaagacggatgctaggtggttcacgctggtttcttgcacacacttttctgatgtattttaaacatcagatgtactgattcctgtacccaccactaccatctggaaatagcactacgaaatgtccctaaggacactcttgttcacaattgtaccttccctttcaccaccagacatggcaactcttccacacagttgtcacttacagagtcttacatcaatgaaatctggggtgaatgtgccatccaaagaaacacaggaaccagagttgggttccaggaacccatgagaaaaagcttgggtagtagcatacactggtagttccagccctgggaagacagaaacggtgaaccactgagatttgtagcaagccaacgctaccttttctcacatttagccctacttggtgagcccaggccaatgagagaatctgtctcaagaagcaaggtgcgcgacatgtgaggaagaatactcaaggtctcctctggtctccacatacacacatgtacatacttatgtacacccacacataaatttgctcctccctttggacacatgtccaggagtgtttagaaactggatcacataccatgtaacctccagagactggcttttttctcattgatgtgaatgtagcatagtttaggcatcctcacgctgaagggcttttggatcatttttaattgaagctatttacaaataacactgcaatgaccacttaagaacagtatcgacatggatttttatttctttgacaaatatccaggagcaggatcgctgggagtattagttacttttataacacaccgcaacaaaatcagcttttgggagggtttatatggggcttataaaggaatgagtccagcaccatcatggtggggaagcatgtctggaggcaggaatggtggctaaacagcagctgagagctcatgtcttgaacaataaacaagaagcagagaggctaaatttgaaatggcacaaatcttgaggtcttaaagcccatccctagtgatgtattcctccagcaaggtcacacctactaagcctccccatacacccatcagttagggaccaagtatttaactgcccagaccatgggggatatctcattcaaaccactacactggataaaggtaagcttaatttaaatgagaaatgcccccgacaggctcaggcattgcacacttggtctccaattgtgggcactatttggggaggtttgggaggtatggtcggtcctgccataggaagtatgtcactgggggagggcttcgagaatatataaccccgctccacttaccatttgctccctctctactgcttgtttgtggttggagatgcagtcagtctcttggttccctgctcctgccaccatgcctgtcccttgcagacggactcttctccttccagacccaaaagctaaaaataaactcttaattccataagttgttcttgtcatgatattttgtcacaacaacaggacaattacacccctctctccccaaggttatataaatagtaaggacctctgtggagacaggattatttccagtctgttgtgttgtctgcaaatcatgtagagagctcttgggatacacccttcatgagtcatcacctatactcagggtttttgagtaatgcagtattgtacttgtattgtccagtgttcctgtcagtaagttctcacccataattctgtaagtaatccagataaacacattggcttttgaatggacactttggtaggatagtttctttagtctgtcattggtgctttatctgggctgagtagatgtttgcatgaagtctacactctttgttttttgtttgtttgtttgtttgtttcaagacaaggtttctatgtatagccctggctgttctggaactcactttatagaccaggctggcctcgaactcagaaatccacttgcctctgcctcccgagtgttgggattaaaggtgtacgaacaccacgcctggctgaagtctacactcttataaaaaaaatagtcctgttctcacttcatttctgttgctgtgataaaacaccttggccaaacagaacttggggaagggaaggggttcattatggcttacagttccaggttctggacagtcgatgagaaggcaagcttagtcacctcacacgcatagtaaaggacagagaaaaatgaatggatgcctgctgcctgctgcctgcttgctgactgcctgcttctgtttatcccctgccataaaatagttgagaaccttctgcatagagaatgttgctgcccacactgggctgggtcctcctacatcaatcaacaatcaagacagtctcccacagacatactcacaggatctaggcaatttctcaaccgagactctcttctcaggtgattctgggttgtgacaagttgacagttaaggctaaccatcacagtgtatattagaacttatttgttctaataaacttagtaattcccatgggtcattagctctacctggtaggaactatctttgtacactttgttaatacaaattgactacttgttttaatacctcatataaaatgacagctgtggcatttgtctttctatgatagagttatttcacttagcatgtctttaaagtttatctgtgttctcatgtattacagaaatattcataatgttaaggctgaataattttcatgtgcatgtgtacagacacatgcacatactttctttgctcatttgttatgagggatcatacaggttgtttccttaagttggctactgtgaatagagctaccatgaagatggggtgaaaatatctgtttgtgatatttagaatggctcttttgggtaaaattcttttgaatactagatcatgtaagagtccaatttttaattttgaaaaaatatttatttttattttgtgtgtatgggtgctttgctagcatgcatgtataccacacgtgtacagtacctacctgcagaggtcagaagagggtgttagatcccctagaactggtgttacaggctgttacgagctgctttatggtgctggcaaccaaacgtaggtcctctagaagttcagacagtgctcttagccactgagccatcatcttctggatgtatttttgagaacctactatactcttctgacatggcatatcattttacattctgtcagttgttcaaaaagcttggagtttccccatatactcattaatactggtttatcaccatcatcatcatcatcaacaacaacaacaacaacaactttattttataatggtaattgtgacagatgtaaagcaatatttcatgttggttttgatttgcatctttcagatgtcagtgactatatcctcgtgggtcactcatatgacttcactgtagaaatactttaattatttaaccccctattcctcccctctccactttttatagtaatgagggttgaacccagggcctcatacatgccaggcaagaacattacccctgagttgtatcagtcagccctactcaatttttcagcctcttttaacatcaagatagtaaatgtgttgctgtttggaaagtttggggattttattacatcttgggagttccttatatactttgataattaaccccttagtggctggatggtttgtaatatttttatcctttttcctgagttgtctcttttttctgttaatgttttctttccttatgtgatgctatattggtctgaatgagaagtgttccctgcaggcctgagcatttgaatgcttggttcctgtcttagtcagggtttctattcctgcacaaacaccaagaagcaagttggggaggaaagggtttattcagcttacacttccacactgctgttcaccaaaggaagtcaggactggaattcaagcaggtcaggaagcaggagcttatgcagaggccatggaggcatgttacttactggcttgcttctcctggcttgctcagcctgctctcttatagaacccaagactaccagcccagagatggttccacccacaaggggcttttccgccttgatcactaattgagaaaatgccccacagctggatctcatggaggcacttccccgattgaagctcctttctctgtgataactccagcctgtgtcaagttgacacacaaaaccagccagtacagttcccagttggtggtgttttggggggaggtttggataccacaagcttgttggagaaaatgtatcactgggagtaaactctgagaacagatagtttcccacatgtctagttcatacctgctgctttgtgcctgtggtccgagacatggctctcagatctctgctcctttcaccatgcccgattgctgccgtacctcacaccatcatggacacttatccctctggaaatcatgaggcaaataaaatcttcttcctataaatcgccttgtactcggtattttatcacagcaatagaaacggaactatgtagatggggtccctgttgtctacttttgcgtctgttgcctgtgcatttggtgatgtatctatgaaatcgtagccaagaataaaggcaaagctctttccccatctgttttcttctgaagttttatcatctggggcatatctttaagtctctaattcatttagagtttgcttctgggcataactctttttctcaatatggcagtgttggggactgaacccacagtcttgtgcatccctggtgagtactacttcatttaatgtttagagaagccccgactattccctaacctgactctccttctcagtcaagtttttattgatggacgcagctccagtttgtatcagagaatgaaggttagcacagtatctgttttcatggaacttctggtaaaatatacatccataggccaatatacatgaaaaacaactacacccctgactgccttcaccaacctattgctggtattttatttgtgatagttggaggtagggtgtgtgcctgccactgcatatgcgtagaggccaaaggacagctttgtgagtagttctctcttacctttcttagcttctaggaagtgagctaaggtctgagggcttgtgtacaagtattttatttgctgacgcacctcaccacccttcattaccaacatttcaatgttccccagctgtatattaaagggcccaagaagtctataatgcagtaacctgcttaacatcactgacacagaacttattaaatttgcatgacaatgtaaaacatacggattagtatataatttaatttaaagaaatcttaatttgcttgcttttataaatgcaatttgttaaattgcctcatggaacagctattttcttcagaggcaaataaaagagacactaatattggtaatcctgcttcacccaggaagagcactggtcctagtcaggagtccagcaccgccgtcactgttgggtatgtctttacatttaagtcaagttcagagttcagagtaagagactatcccagatgctagggtggctttgagggttctgagaacccaaaggtcacgtgaaagatatggttactattgtcaggctgattctaatcagaaatcagagtctggagatggagcagataccattgagaagcagttaggaggtggtaatgtggcactgacaacccagccaaggctcaggtagcggtggacatgcgcatttgctttctcttgtgtttatcgggcaacaagcctgggtgaactggaaagcggatgcggtctgaaggtctgcatgaaaccacagatgtcgatccgtggggggcagactccgggggcatgtgtctcaggggtatagcacttggaggtggcaaggactaatttcaaggtctcacactttaaaagcctaaagtccaagcataggtgggagcccagcctagactcagagcgcagacgcggacagagagcatgctaggagcctctgttggacagtcaaacatgaccgagtaagaccgaaactccatagagacagactgagggaagggagaggttaaagacagggaacctgggctctaagatctccctgtaacagctctccctttgtaagattggatcgaatccctagggtaaggggcacagctgagcttccaggtgagacaagagtagggagaagaaccatcaggtaagacaatatagttagagccccaaaccaatgaaccaactaaccaaccaaccaaccaaacaaacaaataacccaaagaccaaaaaaaaacccctaaaaatcaaaacccaaaccaaaaaacctcaaaacacaaaacaaaacaaaaagacccatgagccacaggaggaacacagttctgtgaaccctgggctcaaacaagggtatggatagaaattaaatgttatatggatggaaggggacctggagaaatcccagtgttttctcttggatgaagactcttgatccctgaaactaagtctcacaagcccagatgaagttgtgagtttaaatcttgtcaagtgtgaaactagagccaacagtcaaatgcctccctccaccagctaaaccagtccattttaacctgtggattaaattgtggtttaattttaggccagaaaaaaatttttacttgccataaatttaagtgctttagatacccatgacataaagactggagcattatgtaaaagggaggcacattagaggtcatttaatgacttgtgccacttcagagctttctatcacatagtccacagcaattcaaagtcatgacccctagaactaaaaacattacccatcagcctttgaactctgaaaccggccaagtgtaataagcccagagcaaagtacagactttccagtgactgagcacaggcagtgactagaccagatcggccatagtgagaccacacactggccctactcagcgggcattcactcagcctagattccattttggttgctgctcacctagtctcaaaaagtctcagctaagtgatgtgacagccctttgtgctaggacatgatctgttctaaatatctttccacaggtgtgctgcaaatcaccgtcaacctgataagaacaatccctacaataaagtgagttatttataccaacatcctcccatgttgttgaaccaatgaagcaaatgtggaagaataatgtttggctcctttctgttttgaaaacattttctgggaaagcaggtgtttgcagactaaatagatatgcatgccatgggtgatagatagtcttagatgtcaggtcagttcttcatcggggacagatctttggaggacactgtaatattggtcatgacagaatagattctgatagaagttggtgtctaaaatgaaaatggcttggagaccacaggtgatcggggagttcctcatggctgttacttataggaagaattcttccctcctataagccctgctccatccagctcccaaagatcaaccagtattaagactgacgttgtttaaagcaccactatctgtccctgtatctactccaacgcattgagccagctatatagcactttttttccgttccccaataaccctaaatttcttctacttcttgttggagatgtttcctttgccccagatgtctttcatccatccactaagtacttccatcccttcctgtactagctaattctttcctcccctccaagactcatcacaccaccgtgccctccaggatggcttctctcagtcctcactcatggactgagaggtgctcccacctcacttgcctggtaggtgctcccacctcacctctgcatgccaggagctaagaaaaggaagttagaacattactagagattcgcttggaaggaaggcaggaactgagatggaaagatggggggggggggaatgataaaccatatggagccacatgaaacctggggttgtgtgcagtaaggggtgaaaagggatctggctaactgggtgttctcaacgcaaggaaagttcataagacaaacccaaatgagaccattaatactgccaggtacagggcaatgtctacaacaacgacgatacagaataacccgtggcctggagaggtggctgggtacatagagtgtttgctaagcaaacaggaggactggaaaccagaactttaggatcatatacattccagatgagcctggcagcccaccaataataccaatactaattaggcagaggcaaggggagctccagggcaaggtggcttgctgaactagcaaaatcagcgtgctccagattcagctggaaaccctgtttcagtgaataagatggaggcaataagacatccagtgccaatctctctttcccacatccacatttgcttggtcacacaggagtatccacatccatccacatgcatgcatacacagccccacacgcatacacatgtgggagaaaaggaaaaaggaaagaataaagtaggtagacatgacgtcgagaagcaatttaagcagggtggatgtgttttctgtccatcccttgtgtgtttgtttctctttcctaagctccactgttcattaggggaaagttcaactcacataaacttttcatgtcttcttcagatatcctcaccttgagatgatgtagtgagtagggtcttgtgcacaaatccctcagggtttggagtggggtatgggtgtcaaagggcacaggtgaaacaaacctggctgtgcactgattcttgtagggtctagggttttatggggtgcttctacttttggggggacttgacaattattcacaacaaaactacaaaacagcgcatcaggaactatgggttcttctcaagtggagggcattacatattaactgaatgcgtacacatgcctttaagatgggatatgcatatgcactgtctaagataccccgagaaggcactgggtatttcagatgctgaacacagattttcctaagctcttgccttcaggccaaattctgcttttcctggactatggcactgtgcagagaaaaattatttgagggcaaggtggtgagaagtcttaaaggccccatagccgaggatggggtagggctgtctcttctcctgtgatcactgaaggcctcttatattcaacagacaccaaatctgagaggtcctaccatggccaaggccatatcccctttcttatgttcagagatggaaaaggaggataatcaaagtgcttaactcacagggtcattagtaccatgaatgtgttaaggtttagtccagtgagttgttagcatcgggcatctgtgctttactatcagagttagtgtttgcgttggagttagtgttatgggtcaatagttaccagttagtcagacacacactatgatggataggttgtttatagacagagagaagacatggttttctgaatataagacggggaaggagtaccagggctaggaatgagcagagaaactatttgaggatgcagctgtgtataatttaggcagggtgtgtaggggaggggagagatgtgaaccaggaagcaaggcagggctggatggatgatggtgggcctggcatggggcagcaaagttgagacttgaagcaggaggccccgaggagccagggagtgacctggtccagggaggggcgagatgaaaacatacttcaggaggattaggctggcatgagatataaagtgtctcggttttgggcaggttcagaccaagggtcgagaagtccctacagagctggaaatttctagacttcctccagcctcaggctccaagctacatttttgccaggctgagtgggaatcctggagttttccatgggacccaacaattcatctttgtgtcttctgttaccctcagctttgtttttgtgttgcgtaacatttccaggtctcaatatcccaagcaagctggagttttcagaggttaaactctagaacctacccagcctgggtggcatctctggaagcaaaaagagacaccccccttttgaccagagatccttgtagacaaatggccttagctgaccctggctgttctttggttcatataacaatactcctctcctctctctagtccttctcccaacctgtttagacacaagacttacataaaccttctccactcccctctgcttcttcaggtggaaccttgaagaaaaaaaaagttgttactaggccaaggagcaaggtttggaaagacacgatgtgctgccaaatccaggaaagcaagttaatgagaaggtgagactctgtccacccactttctttcattggcggaatttttaggtaacaaacatagctccaggcaggtgtctgtgccccactcccatgctgagcaggagctggacccgagctgcaggtcccactcagccattcagtggcttcatctctgcaccatctccagacccctatgtccaattgcacagcagtgatccaggtccttccctctcgaagtccttttgagctctagctttccaggatgcccttctacgggtcagtgtgttggtctggatgagtcctgggtctgaccagaactactctgaaagggaagataaagaaagagccttagaagaactagctgtcctaacaacaggagaccccgtactcacatactaatgtgcactcatgagctcatgtggaagtatacatataagcaacactggtgagcacatgcacacacacacacacacacacacacacacacacacacacacacacacagcatgcatgcatgcacgtaaaataaagcttataaaacaaaacaaaacaacaccaagaagcaagcaagcaagcaagacctagggtttttatacatctgttgtgggattgttgttgttggtcttattgtgttttgcatttttggtttgagacaggttctcactatggaaccctggctgacctggggactgcctgcctatgcctcccagagtgctgggatcaaaggtgtgtgccacccatgcccagctgctgtggattttataggtcgttgatggctgggttttggttatgagtttaacactgctgttgaatgcagagagccttttaaatcgagcatcaatgaggggttgttttgttactgaggggctggacatgggtttgcttaggactgagatttgctttctgttgcctcccttgttctgagcgcaattgcttagctagatgtcgatggcctttcaccatgggtttcctgtgagcgttacaagctgagattggcaggtgcattgaggaggtgggcaaggggaggggcgacagcacaatgctgtttccctattggtgctaagtgctgttcctgtttaataagtgcagttttgaactggaagagaggaggtgtgaaaacaccacacgagtcccctaaaatagcctcttaacaaccaaatcaggagtagaatctggtctccgttcaggaaacagggtgcttggatgtccactcccctggggctccttagcccgtctttccccttaggttcaaaggttcttcataacctttgggtccattgactttacttctgataatatcaatgacctggggacatccaccttacatatgaaggacccctgtcggcatgagtagttgtctattaactgtcaccatgtagtcagcttctctggcagagatgattacaatctaagtctagaatgctgggaccctttaatacagtttctcatattgtggtgacccctaatcttttttttttttttccgagacagggtttctctgtatagccctggctgtcctggaactcactttgtagaccaggctggcctcgaactcagaaatctgcctgcctctgcctctttgttgttacttcatacctgtaattgtgctactgttatgaatcataatgtaaatatgtgtgtttttgatagtcttagcccctatgaaagggttccttgaaccccccaaaggggtcgtgccccacaggttgagaaccagttctctaaagagccatttatgaccccctctttggctatcaggcttctaaaagaatttccctaggaatctccacatgggagaagaaatagccaaaaccccagggacatccagaggaagacctaatgttttgtgaagaattttgcaacttattagatgacttcatagagagttggcgctgagacggccgtgggcagaggccacaccttgtctgaactattcaactatgcatatcttttctttttttatgtaccctcacgtatggaatttgaaatcaaacttggatgtagtggtcactgtatttcctttgtccctctttccattgtggccactttgaataaatctccattttaatttggctcttttatttggcttgttcaggataggtggccaaacctggctagttgggggctcaggttgaaaccctaatctggtaatagtaacatatgtcctgagtctggacctgtacagccatgctcagtaatgaagaacaagcagcatattggatctctcctaaggggtgaatttcacccctgctaaataagcaataattgatcaaacaaggactggctgcatgctttttatgctcctcagtattcgggggcagcctcctctttttcactactccaaattctcattctgacttgagcttagagttgtgtttactccagactcacgcggtttcccttgattattattgtgtgcctctccctctgaagctgaagaaatagctgatccttacgtgcttgtggagtaagcaaagaagtcacatgactggatcagtacaaaaatgtattccgctttgctgtagtccagtgaatttgaagccatggatattttcccttttaaatgtacagttcatgtttagagaaaggaacgcaacgatgtatcaattgcttgtatacttactgtcaaagtagcagaagttaacatttaggctcagtacttttgaatttccttctttcttgaagaaatggagcattacattcatttccatctctactgagaaaaccagggctgagtggccagccatgtgcttgctgtctaaaatgcactgatggggactggagagatggctccatggtaaagtgtttgttctgcaagtatgagatcttctgtctagacatccagaacaacatctaaaaatatctagatgtgatggtgccttcctgtaaccccagcaggggtaggaagggaacaagtggatccttggggctgtctgatcagccatttcaaagaatcagtgagatccatcatgaatgagagaacctgcctcaggaagtaaagggagaggctggagcaatagctcatggttaaaagcactggctggttccagctctagcagcaatctacacggtggttcacaagcctctgtaaccctagacctaggatgtaatgtgcccttccagtctccaaggatactgcatgcatgcatggtgcacagacacacatgcaagcaaatacccaggcacaaattaataataatgatgatgatgatgatgatgtagatagatagatgatagatgatagatatgtgataaatagataatatagatgacagagataaatagataataggtgatagatagatacctagatggatagatagagataatatagttagatagatatagctagatatagtatagatagataaatagatagagatagataaatagatagagatagataaatagatatagtattgttcaatagagatagataatagatagatagatagatagatagatagatagatagaatagtatagtatagtatagtatagtatagtatagtatagtatagtatagtatagctagctagctagatatgagtgtggtagcacatctgggaggcagaaaaggtctgcaagtttgaaggcagcctggattacaaagcaaattccaaggctacatagtgagacattatcttttaaaagtacatatataaagtaaagcagaagcagaaataaggaaggcactgcccgttggcttttgtccacatacacgtacacactcttactcacatgtgcacacatataaccagggccatacagaatacacacacacaaagtctaagaatctagggccaacgagatgtctcactgggtaagggcacttgctgctgagcttgatgacctgaggttaagccttgagaccagctctcacagattttcctctcatctctacgtgcatgcaagtgtgtgtgcgcgcacgcaggagtgtgcatgagaccagtagaggggtctttttgtccattgtcatcactgtcttcaaatcagccatatcaggcacttggaacttgtccctttcatatacttccttagaaatccctccgttcaatgtcacttttctcatttggactggttaaacaattccctggactgttctctagaaagacagatgtgtgaataattaactcaacctcattaatcagttgctaccccggtttctaagcttcaaagctgagttacttgcccttagagcatagaattggtttataaatggtgtatgcattcatgtatgctaaaggaaattatacgttttatagaactgagaatatgtaaagtatataaaatgtactgtgaaaaaaattaagaagatagagacgactttttaagcaaattcaaagagcttaaagtcttattgtagatagtgttttaaatttttttcacttataattattgtgtttgtgtgtgactgtgtgtgtgtgcatgtgtgtatctgttcatgtgcatgttccacagtgtgcatatggaggtcagagggcaaactttcagagttcacgttccactgtgtactcagaggctcaaattcaggtagtcaggcgtgcacagcaagcatctttctacaccgagggatcttgcaagcccaagtgacatcatatcgatactcttaaaagtcattgccttcaagggcaaaggtgatgtcataaaaaagctcgtgcttaagtcagcttaagtcagagagcagcctgcagagttctgtgctgctgacaccgtgctcattgcactaagcctggaactatgggaagctcacagataaccaatacacagacagttccctgaagactgtagtcaaggagacgggtgcacacagctaaacagaccacaagccagcgaagcagatgctgtgacagtcacttaaaggacatgctgtgggtgagactagggagctgggagtaggtgccaatacagcaaaattccttgtgcttaccaaatggtccatcctcactgtcagatggcaggggcatgcaggacacagtggtggtctttgacttggttatgaaggatgaaaagacttcaacaggaagacaaattggggatgaagatgtaggcagtggagggaaaggagaagcagtctaactggggctgaagagataaccagaggacacagtgttggatattttcactgagattaatcaacagttcagtctttggtccatcagcccctcctccacacacacatcccccactcgtttttttgaggtatggttcacgtgttccaggctagcctcaaactcaccaagtggttagctgaagatgaccttgaactttagactctcctgcctgtacttccccagggctgggatgacaagtgtgcactgccctgcctcaggtgtgcactgccacgcctggcttgtgctgttactagagatggaacccaaggcttctggtgttctgggcaagcacagcctggctcacatccccagccctggtccactcttgtctctttccacagtgatctatctagtcttggtcccagcaccttgctcagagggagtggtcaccgatgacctctccgctgtttacctggatggaccctccttagtccctcattccttggcctcttgctgatgtcacttgtcacgtcaaccttgatgtcgatggccacactgacatttgggtcccttgtggtcttcatctgtaacatcctgtccaccgctgtattctctttgttttgttttgttttgttttgtattttcgagacagggtttctctgtgtagccctgcctgtcctggaactcactctgtagaccaggctggcctcgaactcagaaatccgcctgcctctgcctcccaagtgctgggattaaagacgtgcgccaccactcacggcaatattctcttttatctatgttcagatgccttttctctgtcagttcttcctcatcttacatctttatgagcatgtctcctgcagtcttaaggacatgccctctcctacaccatgcctgaattgttcatatctaactttcaggtctcatcttaattattactcaccttaggaacagtttccccaaactttgcatctgtccagtaatgagcctagagataaaactttatcagagataaatgcctgagtacccagctgtcttcctagattagcccatgccattctttagtttctttttttgcataacccgattataaatgtaaaagtcatgtttaccataatattcccagcacttaacacaggctaatcaatatcaagttcttaataaatattcaatgagtaaatatgttattcaggcaacatcaagaatgctgggttgaataagtagggttatataggaagaaacaagagaagaaataggctggatgaagaactttagctttccacttcaaacatttaaggctattctacagataaaactgctatttaaagttgtggtccagtcttcctctagtaacatgctttgttagctggtgtagtgtaaccaattagccagtttagtcaagggttagcagggtagactacaccacaactgtaagagcagcaagacagaaggactgaacagggatggtgcccaagagaatgctgggagttgatagcgaggcaaggccccattcggcatccttttctgccctgttatcattcactaggagaaaagagtgcctaaggaaagccagacttagaaggaagagaggcagagagctcatttcctgatgcagaatcagccggcaggatattagtctatagctcaggggctccctgagcaggagctgtggatttgagagatatttgggaagaactattagatgaagatgtgagggttgtcaaggaaagcagacaaagggaagcgagtcaagagctaggcatgtgtatgaactcaaatagcaacaacaacaacaacagcaacaaatgccatgtatacatggaagagctcgtggccgaaatgacaaaggaaacaaatgttttaaactaaattaaagaaatgatcacgtttagatattgtgcttaaaatcttcaggaggtgaaaggtgatctggaagctgacaccgagcaggggcaaaaagagagcatgtcacagttaggtttagtgggtagaaggtaacatggggatgatcagagaaccactgaagtgggggaggggtggtgatatctttgttcttcagacacagaagagcagaaacaaggactcaggcatgcgtcgtgacagggttagaggcttggttaggtagaaagttaggtttccatgtgtccggggagcggggaggagaagaatgtgttcagggcaaagatccaatgtataaacttttatggccaacagaatgagggctctcagctacagaggaaacacttaatccgcctgtaaatttcagtccgtcatactaacctgacatggcagctggcgtcatcgggacatgagcaatggttccaagcagagttgattgtgcttcctcactctaattattaaccagtcactgtgttagctcattcacgttgagaagcctcccgcctcactacccatctgtatggagacttcttttctacgaaagaagtatgctcattccaaataacatcaagtgtccaaatcattagtttttactctttgttttcatatgctatgggttaagtgcagagctattaaaatacaaaaaaaaaaaaaaaaaaaatctggaatgagccctgacaactgacttgattccaatcttatctgccattttctggctacatcattgggagacttacttaacctctcttaggtcaaactacattattggatgtttcagcccattctaattttttttcttttctcagccttttcaatgtgtatttactacttgaacgtttttcatttaaaaaacaaacaaaaaaaattgaaaaaactcccagaacatctgctatgtgtcagctactgaaggaacacaatgtttaagacctaggttcctctcatgagtcctaagcttgctttagtaggcagtgacagaaggacaaactggtccatccatctagataaacttcggaaagtgaccgtgtccatgggaagtcctccttagacactgtgacccttgagttcagcctcagagaatggatccaagttaattgtaggtgtggaaggttgtgttttgacacaggggacaggcaagtgacaagaaggcactgagttcaagggcacagtatattctaagtgtcagttgccagtggctgaacatagaggagggaaagaggttagagaagccaagttcaaagctcagactatgcatacagtataaggttaaggcactgatcctatagctatgttacctatgaatgagtggtcgttcttgggcaagggacataactcaataggtttttcgcttttccagctgtaaagtggaattgaaaatggtatggcatagcgacctcacatagaagtattcaaaacaatgtctagggcacggttatggttatggaagcctcttgaagggctccagcaagtagagatttgagttgcaggcagaggcaagcgaagagtggattggagagccgtggaaacgggagtggaaagatgttagaaaaaaaatacagcctgcactcaggagagggtatggagatacaggtgaagcagacggctggtgtcagtcttgacagcccatcaggtgaagataggatgagcggtaactaatacccagagttctacttcgaacacatagttttctgtttgtaccctaactacatgcacgcgcgcgcacgcatgcgcgcacgcgcacacacacacacacacacacacacacacacagatacatacacagacagacagacacacataaacagacacacacacacacacacacacagagagagagagagagagagagagagagagaaatgactatatcataggctttggggcagggacaggtgggcctaggtacagagtcctaacttttatcttgctttctctctttctttctttctttctttcttcctttctttctctctctctctctctctctctcccttccttccttccttccttcctccttcctcccttcctttcttctttctttctttcttctttttcttttttcttttttctttttttttcttttctttttgttttttcgtttttttggtttttttgagacagggtttctctgtgtagccctggctgtcctggaactcactctgtagaccaggctggccttaaactcagaaatccgcctgcctctgcctcccaagtgttgggattaaagacgtgcgccaccactgcctggtctacttttattgattttttgatattttccttccctcacaaagaagttgacaaacagcctggcagagctgtgagaactgaatggagactgagtaggaaccgtgccctggatggtgcttggctctcatacctcagatcctcagggaaatgggctggactggggcctagagcactgaatcccctggaaggcccctgttgacaaaatctctccccaaacccgacaaaagcatcacaaactgtgttcttcccagcacctacaggagctacaccttagaacacggatgtttcccaggtgttcttttactgtcctatttctaggaacccgggactcgcacttgtttgaactctagggcgtttaagaagtcactgataaggcagagccagatggaggtgggatgagcaagaactgctactctgaagagagggacaggtgcacagaagactaatggctcagtagacagaaaacccacctctatctacagataagccaggtgacaacattagcctcctcggcagctgtcccctcttctgctgagacctatcgattgacatcctaaatgtcactgtgaaatgttcaagggatactccccacttagcgtagctgctgagccagggaaggcaactgaatgtcttatttgaatgggttgcctggtgctctccagaaaggttccaggctgggacggaaccttcccaagtgaagaaactcacttcacaagcctccagtccccgccctgcaacaagcctgtttgttaacttgaacttgcggtgacacacaccgagttcatttccagtttgcgctccagggcaagtccttgactacacaaagagtgagacagttggggaatttgtggactgtccagttaatcagataaaacccgagagagtcagaaaggcgacttcttggaagatgtcaaagttttactgaaaacagcggaagtgttcgcagctaattggtgctttccttccacacaccccgcactccctaccgccccctccctccccgcctcccatccctgtccagtccccaccccctgaagtttgtctttggtaaaccccagctacttctctcacttgtctctgaggcacaatgggagtcttcatctgaattctagggaagaaaagatatgactccttctagcacgagtgagctggattgtaacagggaacgaattgattgatttttcccccccttcatctcaatgaacacactatgtagccaaaccaaggctgatcaacaacactcaataaaaaaggagattcaaactgaggcccagctgagccctactagacctccacaatgcacgctgtcatctgcttcttacatgtcatcacatttaattatattaatcttcgccataagtaatggaggggattattatgagccttggtctagcaactgggttcaaggtcacttagctaatatgtaactctaaatgttacaagtttctaagccaaggatatgtccttttctcaggccgatgctgtcctgctggccttctaaaatgttagttctctgcctcttgttctgtgcctacctcagtgccccacccccactcctgctccccccccccccattattctgatcacatttacattcccggtctcccattctcctgatcctgtgtgcttacatcagctagaaattatatgcaggacttttaaagagtttttttcatagtattgcctttttgcatatatatatagtgttctttgtttgtttgtttgtttgtttgttttcaaaacagggtttctctgtataatagctttgactgtcctggaacttactacagaccagtctggccttgaactcacagacatcctcctgcctctgcctgacctgtcaagtcctgggattaaagcttgcaccaccacacccagctgcttttatagttttttttttttttaagttgtgtggtgtgcatgttgttgtgttttataaaatagctgtggtataatgtttggggatggggaacatttcagcaggcctctgccaaggcataccccttgaggaatcagtcataccacaggcttagtataaaagggataggggacctggaaaaggggcagaggcagagaaggtgggggacagaggaggacagaaagagagagaggccagctgggaacatgttggggagagatagagagagggaggaagggaaggagaaaagagaagagagagagggggagggagagggaggaggagatgaagaggaagggagggaggagagagagagagagagagagagagagagagagagagagagagagagagagagggagggagggcaagcagtcctttttatacaccaggttggctcacacttggcaagcctcaagctgttgctaggaagctgttggatggagcctaaaggaactgccaatagtgtgtgtacagatgagtttgtgtgtgcgagtctatgtgtaagcatgcagaggccaaagatatcgttctatatgacagggcctctcactgagcttgaagctagtcattttccccaggctggctggccagcaagcttttggaatctgcctgtctctgtcctccaaagatgtggttacagggatacatggtagtgcctggcaatgcctggctttttatgaggatttgaagtcaggtccccctgcttgcatagtaaatgctcttacccactgagccatcacctcagactcatcttattaattgtttcagtgtcgctgtatcgtggacacaaacatatgcatgtatataatagggggagagcagattattctggcatttcgagatcctagcccagtgcaggtgggtggcagtattagcaaaatcactctgatctgatatctgtttattcatgtattcttatctaagtgttggaagaagaaatggcacgagaaagcacagtaacttagttcacagtcacaaagcttggcaactcctagctgggtggtgacacgggctgtacccctatcattcaggaggctcaagcagaaggctcccgagatgggagctagcctgggcgttggagtaaatcccagggtaactttggcttgtgtagtgagttcttgttttgagagactcacgtctggggagccagagcagtagctcagtggttaaatgtactttctgtgaaatcataaagatgggagttcaaatcccagaacctgtgtactgacatactggggaaaacctataaggccagctctggagggaggtggaggcaggaggattgctggagttagttggtgtcttagtcagggtttctattcctgcacaaacatcatgaccaagaagcaagttagggaggaaagggtttattcggcttacacttccatactgctgttcatcaccaaggaagtcaggactggaactcaagcaggtcaggaagcaggagctgatgcagaggccatggaggaatgttctttactggcttgcctcacctggcttgctcagcctgctttcttatagaaccaagactaccagccctgagatggtcccacccacaaggggcctttcccccttgatcactaattgagaaaatgccttacagttggatctcatggaggcatttcctcaactgaagctcctttctctgtgataactccagctgtgtcaagttgacacaaaactagccagtacagttggcttccagcgcagacaggaaaatttgaatcttgattcagaatgagatccgtcctcaaatgaaaagccagaaagtaacagaggaggacactcaatgccctcagtgggcacgcgcacaggtttgtgtatgtgcacagaagatggtatactattaccatacttgtttgtttgtttgtttgtttgtttgtttgagacatggcttctctgtatagctctgggtatgctggaccaggctgacctcaaacttacagagatctgcctgcctctgcttccagagtgttggggttaaaggagtatgccaccaccccctgtggacacagatgtattcacaaattttcaaattgcatctgtttgtttggctagtgcacctggcacagagcgtcctccacatggcatggatgaagacttattccaattggttattgatcaaactaattcatgaaaaagacagctgtctttcacctgcccagacaaggagcaaaaattcatccttatcttatggattgtgcaccttgcacaatccatacaaatattttttataggaataaagatttggttgtaagattcatatattacagaatgaaacagggagatacagctctgacaagattcatccttggggatgctgagatgacccgctgtcccagctcgctgccacatcctgcctcacctgatgctgtttccagagacctgcttccagagcagcgtcaggggtggctgctgattcccatgacatcagttcatccagcctttcagacagatccaccaagacttcagttaagccctgaacattctaagcatacagggactggataacaaatgcgaaaactagctttcttaactctaaccaagttttcttatttccctacacctcccacccccttgaaaaaaattcatcaccccaattcagcaggaagtagttatggagagttgtcatcttgattccttgggtttaggtgtctggctatggttattttaacattattatagatattttaattatttaattattattaaattatagatattttaacatattaagggatactttggaaatgatcataattttagacagggaggaaactagagaggttagacttggagattctgtctttttttttttctttcctttgctctagccttactttcttaggtaaaaggaagggagctgaaatgaaaatggggactagagtaatataggaaattagagatgtgagatggattattcaatttactcttaaacaaaacattttatagttataatctttcattggtagaaatctttacattttgatgcagaactaaagttatattttcttacattggtacagaatttatatatcgatacaggtttaaggttttcactggtataaatctttgtatattgatataaaatttaaaattaattctgttactcttagacaggcattgtgcctatacaactcatttatacaatacaaggcttagacccagtccttctaataggtactgtcacaaatggtttaagatgattaagtgatgcaagttaatggtcagatagtaaactcatgctcatattagattctgatttaattacaataaagtgttttcaagattatcacgtaggaaataactaagagtaatcaatgtttaacaattcaattatattacatatagatagatggtcttcaaaaacatcagaggtccacaaaatatggcatttaaaatcatttcactattaataggtcttttgactaggagacatgtctgctcctaacagtacccccatctcactgcaaagaaggtactgagtatcaatacctcccaattggagttgctttgattgcgatgagctagctgctggtaagaaatagcctaatttaattctacagacaattactgtccagaaaggacaaatggatgcaggacagttgactgctaagctctgccaaaacagagtaagctagtcctttatatttcctgcttcatttatggtctatcagatcgttctggaccagaagtctgaagacaggtgctccaacattataaggaatattgaggactgtccaggcagtcagttgttcctacaaattgtattaagttttagaagctatgtctttgtgctttctacatattctgataattttaaattccttctcagatctctgatggaattgaaaaatagttatagtctcataattgaacttaagttatttagcactaaagaagatgttctagatttgaaaggatggttttctgagggtattgcaagttaaaatcaagcataattgaggtacagatttgtaaattctgtaagttaagatagataatagagtactttatctaaattgtcagatatgatgtactggatgttctaagtgtatatcataccttacaatttacatacttgttataactgtgttcaatgtatatttgggagaaaagagtttttaattggacaaaaggggggaaatgtagctgtctaatgctaattatgtttcctcataactatttgcatgagagggtctgcacatagcttctgggaaccttcccacagttaattctgattggtaaataaagttcccagcagccaatctctggggagaagaaaaagaggtgggtggggcttaggtttcccaggtgtgggacctctgggaagagagaaggaagagagactcaatgcctgaaaggtagtataggacaaagaggcagagccaccctgtaaaggggccaggagagagtggcccagatggctgctcaattgggccaggagaggccaagatggaacatagaaattggtaagtagtaacttggaattattggcgggaggtagagtctagcagtatggaggctaggcagatgcccagctattgtgctgcttaagtcatattaaaatataaaggctgtgtgtgagtttttcattagagatcataaaccattgaggtaggaagtaatgctgtgctgggatttattaaaacattaatactacacttgtggcaatcacaggacagacaacttgtaggaatggattttctccttccaccatgtgggtctagggaattgaatttaggtagtttacagccttggtggcaagcatgttcaagccagccccaatttaatgattttaattaaagttgttgtcctctgaggcacaaaaaaaccccaaagggttcaacacaatcaggattcctgctggcctctcatctacagcttgggccagaagccttgctctgttttgcatttggaatattttatctcagtctctgtaagtcaggcccagggatgggtatagtcagtacacatgaatttggtctgcataactggaaatgtgattatagcttctcagctgttccaaaggagaagcaccatcatatcccattctgcctttgtgtgaaaaactcctcaaaaatacatattagtttgtatctcatatatatgtatacatatacacatgtatgtatgtatatatgcatgtatgtatgtatatatgcatgtatgtatgtatatatgcatgtatatatgtatatatgatgtatatataatgtatatatgatgtatatatatcacagacacatataatttaggtcactttttgtccctatgttttatttctttcaaaacctactgctgcgccttacacagtgttttgagaccatcttctttcttatcttttttttctcacataatatatcctaattacaatctccactccttctagtcctgctagttcctcccctcctatccagagccacctttctgtctctaattagaaaacaagcttctattatatagattataataagacaaaacaacacctaacacaactgaataggacaaacaaaaaggcagaaagaaaagagaagtcacaagaaatagatccacctgttcacacactgaggaattccatataaactctaagctggaaaccataatataatgtgcgaaggacctttagggtaaagagagagaataaaactgcataaataaaataaagtaaaaataataataaaggaaaatccctgacacagcacagtaagacagggaagctccaaagactctgttgagttcattctctgctgaccatctagttctggacatgtaacctacccttaagagtcgtttgtttccacagcaagactgtcttagaggaaactaaattttcatttggaaatggttatcaactggaattgcttctgggttaggcctaggggcttgtgtctacatcttctctcagctctagggtccaatcttgtccagacctgtgcaggtccatgcatgctgcctcagtctctgagttcatatgtgtatctatcggcccttgttttcttggtgtgccccatcccttcttgctcttgtattttgcctccttttccctgagccccaaaggaagggatctgatggagatagcccatttagggcagagtgctttaaggtctctcatttcttacaaatatctgtctgtgagtctctgtgttcccatctgctaagggaggaagcttctctgatgatggctgacaagacgccaatcaatgagcatgtcatcaggggtcattttatcgttacatttttgtttgcttaaaaatagtaatatttggttctaccctaggttcctgaactagcttgtctcaggttcttggttacccaagcagtgtcaggtttcatctaatggagaggaccttaaatcaaatcagatattagttggttactaccataagatttgtgacaccattgccctagtgtattttgcaggcagggcatcattgtagatcaaagagtttgtggctgggttggggtttacctctctcctttggtagtgtgccttcccataccaagaactctggtagataaaggtgaaggctctatgtaggcaccagctcaatttctccacgttcaatgggttgtgtaggtgttgtcttcagcaatttttagggtcacttatatatactatcatatcatctgcaaataaacacactttttcttctttgtttccaatttgtatcccattgattttctttagatgtcttattgctctagctagaacttcaagtgctatattgaaaaggtatggagagagtagacaaccttgttttgttactgctttttagtggaattgctttgggtttctttccatttaagttgatgtggtcttgctgtaagctacctttattatgttgatttatccctaattattccaggacttttattatgaaggagtgttgggttttaacaaatgccttttctgcttctaatgagatgacatgtggttttgtctttcagtctgttaatacgatggattacatttactgattttcatatccctgcatctctgagatggtgcctacttgatcacagtgtattatctttttgatgtgctcttggattcatttgcaagtattttattgacaatttttgcatctatgttctgtttgaatttggtctgtagttttctttccttgttgagtctttatgtggtttgagtatcagggtcactgtgacctcataaaacaaattgggcagtgtcccttctatttctactttgtagaataatttgaggaatattggcattaactcttctttgaaagtctggtagaattcttcactaaaaccatctggccctgggatattttttttttttttttttttttttttggttaggagacttttaatgactgcttctatttcactaggggctataggtctctttaaattacttagctggtcttgattcaactatcataagtggtatgtatagagaaatctatgtgagctgaagagatggctcagcagttaagagtttgctgttcctctgtaagacctgaatttggttcttagaacccagattgggtaactgatagctgtctgcaactgcagttccaagagatataatactctctcttctagacactggacatggcacacacacacacacacaaagttgaatgcaaattaaatggtagataacggtatgtgcacttcagagtttgtggtaagtgacagttgatttacttgatgcaacacagagtcgtctggaaagcaaatcttgtgcaaggatcgcctaggttaggctggctatgggcaaggctgtggggaattgtattagttggttacttgtggtaagacctatcctgattatgggtggcaccacctcatagtctcagtcctgggctgactgaaaaggagtaagctgagccctggcatgtaagtattaattcttggctctctgctcttgactatggatatgatctgactatctgtgttaagttcctgctgtccccactgcccaggagtgatggccctagcctgcaactgtgagccacagaaatcccttttctcttaagttgcttttatttcggggttgggtggtgggcggtgagaccgaggttttgtttttgtttttgtttttgtttttgttttgtgtgtgtgtgtgtgtgtgtgtgtgtgtgtgtgtgtgtgtgtgtgtgtgtccgtgtgtgtgtcctggctttcctagaactcattctgtagaccaggctgacctcaaattcagagatgggttcctttgaggcaagcaacttctgaaggctaggaaggctcaagcacattggctcctgggtccacagtgctcagcatctgtatttcatgaacagttcctgggtcctctgccagggctgtaagaagcacggtgtctgcttaatacaactgcagccaaagaagacagaggtgttggtgcaaaaacacagctctcacatcaaagcaggtaatagtttattctgaagccaaatatgagtcccaatggcctagtaatacagatttaagttacccagcattctgtgtccaatgtgctaagatttggtaaagtttttatggaagcagaagaagtttattacaaatccgggtacttttcaaacacattggtggaggcatcgggtaggtggatcacagcaaagcaggaacaactttacttgaggctcagatgctgacagtgtttcacagcccattggttggccggaaactaagagttcgcacattctacggaatttacctaatggcacatggaagggcaataaatggctgtttaggatcctaaagatgccccaagataatttggctctagacttgcaacattctaacccctctacatcattgacattctaatcagttccgtcagcctttccagggctggggggtaggggaggaaggcaaggctatttgaggaatagcttcactacttgaacaccacacattcagggctgcaaaggacacacaaggctctggtctgtggttactagacctctcatcaattcatgaggttgtagctatttcgaactctggaccatcttgtagaggaatgtgaatgaggctgaatttccgacatgcctttggacagatgttcgtgatgctaactctagtttttgtaagatagttattctcttctgtgaagtgatgaagaatttgacacagttttaaagaatctccgtctctctgactccgtctctgtctcaatctctctctctctctcttcaaattagaggtttggtaatttaggcacagggctgctatatgactctttgatagcctcacaggcatgtgtacttagtgtgatgctcagcactttgaaggaaggaaggagggaggaagggagggagggaggagagagaaaggtgaaaggagggatgaaggagggaggaaagaggaaaggaggaagcaaggaactcagttataggccaaagagttttcaggtttatagacacatagatggttgcagctgtagcctggcagtctacataaaggacacataaagacattctcttggccacaggttgctaaggctgggtaggaagtctgtagaaggaagccagaagtcagtaagtcacagattaaacattgagcaaaggaccacatcattagtcactcaatgctagtgtttatttgtctttctcttttgtttgtataaatggaagtactctctagggtttctgtttaattaaaaatcttattaaatataagcaatgaaactggcttaaccaggaaactgaacattaaacccgttcacaaaacgtatgatctgactaggagaaagagaaatgtgctacccacaccaatcctggttggacatgtgcctaagccgaggtcactactagattcagtcagtacccagagaaggtagcaaacagcctttgccatataactgaatgaagggccagcctcatatctgggtttctaactgcagaacacatacatgggtgtgtatcccaggtcaggttgtgggtggcaaggccttgctgctgtataggggtcagggctcttcttgcatatctgtgtttataacaagagttgcttctgggtggcacagactaggggagacagctcctccttctagtatctttgtcaagggaacacactataaccttccatggtggttagcttaactatttcctgtgggtgtgtcccttattaaaactatatcctaaatatggtcctctcttaggaggcatcccatttcctagtcagtcatcatacatgatatacaaagagaggtatcagggcctgggctccatggctgtctagatgtttctcatctgttgtgggggatggtgcagcatgccctgagctgcctgagtcactgcaggaatgaggaagactcacagggaggagggaccaatttccttcttcagtagagtcagagagctgcataggtgagatctgagctgtgcaaggagtgggcagggcttagatgtagaaaatttttaatcctgacctggggcttctaccctgcctttgactctttagttcccagatagaagacacacacagcctttataattacaataaaccttcaacagcacaagagctgggtggatacttaccctctacgttattagaatctactttcctattgataactctgaattattacttactacttaactatgtttcatctgggctgctcttaactccaattggccagccctcagggccatgtttttatgattcccaaaccatggcaccttctcctttgtcttctgtaccttctagttctccttggttctcctctgacccatgaggtcaccccaaacctctaatccctccagtaattggctgtagagaattttatttaaccagtagctttaaatcaagggacaaggtttgcagaacacaagcttgtaaacaggagaagtcttttgtaggccaagacctttggctatagaatttagcattacaatgcatagcatcagaccaaacctcaacacttagaaactcagcaagggacaatgtgggcaaagacgtggagtgagagccccctcagggaccccatggtcacctgttccccattaaccacaggtctttgggattctgcaaacccccagcaacccccagcagctgctggaagcaccatcccatactccatgagtgtgtatccaagctttgcaattctgaagtcctatgagacaatgtgagtagtgtgtcattgtcaggattcatgtatattgtagacacaagatttaatgaaatctttctattgtcaaaagtgtttctaaaatgtttggaattacattagagcagaaagagctccaatttatgttttgctaggtaccttcccaacttagtagctttatttatttatttatttatttatttattatttttgatcatgtgcaggctcccaaagtgcatgtggaagatcaaaggacagatttgtggagtcatttctcatattctaccttatgtgggctccagagctcatacttaagttgttaggaatgtgaggaaagtgctctacccattgatctatcctgctgaccctttagccattttaaatagcaaccatttctgacagcatttggcatctgaagatcaagaattcaggggctccttagctgtgtgggtctggccccaggctctcaaaaggcagtgagcacatcttggccaaggttatgtcacttgctgttgaaagatcaaattctttgggttcagactccatcttagacaaacttgacttaagtaaattaacaggtcggtacctagctccagtttccagattacccaaaacaaaacctgagcttagctccagtttccaggctacccctaacaagatctggatctccagtttattctcctctaacaaatccactgtctagcaccaatttccaggttaatccccagcaaatcccaacacctccaggttacaaggccgcccctgcctaacaaccaccaattaggaggaaagccaacgtttggctcccagcaccagccaattacaccaaaggtcacagtagcaccccaattagatgcttgctaggcttgaaacactcacccttcacttgtgatttcctataaaaccttgtcccagtgagtgatcaaggaatttttccatggaaccgtcctgtgggtcagcagtgaatcaagacccacgctcgagcttgtgaataaagtccctggtgtgatagcatcggatccggctccttggtggtcttttggagttcatgaacatttcagcatgatactgtttaactggcatgggcattcttcttgtggtgggcatctgttcttcaaatggcgcatctctgtgtgagtgagtgtctctatggcatggtggttggtcgccactgaaatgacttttgtagaagagcaaacagataaaaggttcttttgtgccgtagtctctgtcaaaccatcacttctgctgtattttatcggccaccctgagcatccttgatttgatgcagaagaggattatgcaagcaaataaataccagaggatgtgtaccactgggaaacaaggcaaggtcacctctgaattcatattctgggaagattagagctttcagaacaggagctgggcacatgcctgtaagctccacactcagaaggccgagcagatggttcacaccagtctcagttacacaagtcagttaaggtcaacctgggctacttgacaccctgtccctacaacaaccaaatatacacgcatgccagagatgatatagtgaactagacaccctaaaaaaatttcacctttaacgtattgaaaaatactgagtagaacattttaaagatttattttggtttttaaatgttatgtctgtgtatatgtgtctgagtgtatatcgcatgagtgtatatcgcatgtgtctgagtgtatatcgcatgcatgaaatacccacagaggacagacaatgtcgccagaactctaaaactggcgttacagacacctgtgatccaccacgtgggtgctgggagcccaatcctgatcctctgcaggagcaacacaagctcttagtcactgagccatctctctagccctaagagtcaacaaataaacacacacacacacacacacacacacacacacacacacttaaatctttaaaagctgccccattatactatcaggagaataacaggtaaaaccaacacaggaggaggtgtggattgagagactcgcggagttgcaggctctccttctcctgctctagttcccagtagcttactattcatttaacaatgtttatggccgtttgctaggcctattcctcatctaactcctaacttacttaacctgtttaaactattctatgtctgccacatggctggttacttctcagtatcatatatctaatttcctcagagtgcaggtggtgaacctcccagagtttcagtctgtctactggaactcccagtttctacttcctgcctttggcaaaaaacaccatgcggcatatttggttttaccccttgacctagaaaacctcaagtgtttatttcctggccctttattttctaaaatgccaataagataggccaccagatctttaatgacaggtgatgcttcgacacagtacctgagagattatctctacagacataagtgcttaagctgggggctcctctaggcacatccctcaaccaccaagtgacagggaagcttggtgagtttctttcacatggcaacaaacaaggcacctcagctagcaagcaggaaagcaggagataacatgtgacggatgtaggcgtcagagcaaagacccttccagaaactgcctcaaatctcaatggatatttctcagtgatagttcacatcaggctttttttttttttatgagtactatttttcttggtttattcaataggctgcttcaatttaccttaatgtccacttatacttatatataagcttcttttatacaagctcagtggactcactgagaaagcacaactaggaatgcaaatcagacagcaatattaatacagagttcaccttctcctttcaatggaataaataatgcgtgcatttgtctctttctaaatatttaggcaccaaaagttttcatgggactctttcttttttattttatttacttattaggtattttcttcatttacatttcaaatgctatccccaaagtcccccataccctcccccctcccactcccctatctacccactcccacttcttggccctggcgttcccctatattggggcatataaagtttgcaagaccaaggggcctctcttcccaatgatggccgactaggccatcttctgctacaaatgcagctagagacacgagctctgggggtactggttagttcatattgttgttctacacatcaggcatttcttaattctctttccacatgcaaggagataaaacctttcctacttctacagtagctctgatggtcagggaaagtcaggaattataagcagagtctgggtttatatgggcttgcagccacgctcacccagcatgagttacagaaacctggctgatagtctgtttggaaatgtgacccagcatgagaagtgttctctgtctagaaacaaacgggagtcctgttgaagcacatgatgtctttggttttgccccttcgtttagaaagcctaaaaagattattatctggccctttatttatttttaaataaatgtcaatgttagttgcagaaatacctgcatagaagcccccagttagcctagagttgaaatacaggaaagatgcatttatcaaactaccctgtgcagcagaacaaactgaattagagaccggggcaggaggaagcttggttagacacagtcttaggcttggttaaaaaaagggggggggggcgttatgcattatgtacagttaactgggtacctgaaatagaccagacttgcttctgagcactgagggcttaatggttaactataaggagcctagggaggaagattggttcgagaacatagttactcctcaattgtgaatggagttctgcaaacagagaacattaagaggaacagaaaaggagaattcttttggaataatagctctctgccacatgtacccaggtgctctgatccccaaatacatcaaagctgctttgtcacccagtctgtgccagaatgggcttgcacaatgcatctgagcaccgagtgctaatatgctctcctgagagcagcagtggggagagtctgagctggtggcagtgagctagctgcagattgctctgggctggtggcagcaggacaagtcaattaggggagtgattgggagaaaggaaggcaagaggcacccagagcctccaggctcttgtttgaaaaatggaagacacacctggctttttccacatttccctaggtgctcgctagggcctggtcacctgctctcctgattgactcagcagggattgggttgtaaaattaggggctgggtgatgaggcagcaacttccgagtgcctattctgtgcatgtctttgtacatttatcaaggccctcaaatcaccctcacagagcagatattggccccttgttttgcaaatagggataccgaggtccagagagaggtactaagactacaaagggagatgccacccccaaatccttctttctttatctccaagtaattctagccaaggaccacatgggagggtgggtgggctcagcccagctctccttctaagaacaaaaaggacttatgatgtcccctgggctccccatttctctgtgagagtttttaggctcaacccatgaggcctagaccttcctgagaatggacaggcaatttatggtagctgaggaaaggaggaaacattttctttagctgtgtgactgaccactgatgagtggcacatgtgcctataaactcactgggtaacatacacagaggggcatgaaaaaaagaggggggctagttgagaagaagggaggggatcaggagtgggagggagagaagaaaggggagcgatgggtgaatatgatcaatatacattgtatacagggatggaaatgtcatgataaggccattattatatataattgataaatgcttttacaaaatcagaacagaaagataagctgaggaggaagttcagaatcacaaataagtaaaataacaacagggaaaaatctttctcagaacgttgctatggagatagccacatgctgtgtgagtggagacctcaggttttcctattgggcaagatgcattgagtagctacagtcagggaaagccaggaggtctgaacctcgatgccagagagcccatgcagagttgagaacaggaggaaggttctgaggagcccggagggtggatgtgggtgacaacttcagaagaagaagggcaggctggaagccagtatatggagacagatgtcattcctggacctcacggctaccttgctgagctcactttctgccagcaggagaaacatgccctgaagatgtgaagatgccagagaccggtacagaaaagcgagaggagcgttgttgtggttggttgtatgtgctgacttgatcaggctccagggtgctcaggtatttagaaaagcatttgtaatggctgtgtctgcaagggtgtcttttgatgtgtgctaccgtgacctggcagagtgaagtatacattgctctccccagccctggtggacctcatccaacccattggaggcctgtgttgtgcaaaatcgcagaggtaggaaaatgtcttccctctgcctatttttgagcgtgagcgtgaatgctcttgcctgtggagtaagacatagactggaccttacctgtgttagacctccatgcttcttggattaggatttggactagaatttatcagctgttctgggtttgctgttgtgacccacaggtcatcacactcctcagcctctgtagcactgtgagaccattagttataagaactcctggagttggagagatggctcagaagtgaagaatgcttcctgctctttcagagaactggaggtcagctcccagcagctgtatcaccatcacgtgacttacaaacacctgtacctccggttccaagggatcaagtgccctttcttgcctctgtgggcacccagacatgtgcataaacgtacacagatatacacataaataaagtaaaataaaataacatgaatcttaaaggaagaaacccagtcaatcatcacccatcctgcctgcatcctcttggttctctttttctctgggtcaaatggattgccccatacaagcatcttcttgctgccttctctacaggctggggctaaacagggaagttatgggtggggacaactttcagacagatcaagaaggaggaaggagcgactcatgattttcaaagacaacacaaatgttggcagtttggggatgtaaccgatgagggcagtggactcaggggcagacccgtgcgcatgcgcccacgtgttgccatggcaccaacaccatgcgctcaatgggatctagccacacttacgttaatgctctggtactacagagttggaacttttagtaagtttgagcgaggagtaatatatcagtggtgatgagcatgcagggttaggtcccttagagaaatggtgactagggtgggaagtgacacagctgttgccatatcaaggctagagagttgctccaccgaatagccataagtcctagtatcagcctcagagttcaggaactctgcttttcttgtttgtttgtttgtttgtttgttttcttcagacgattctgtgaagggaagatggaaagtgttaattatataaactgaagacgtttccctgtgaagtaaggccagcccatacccagccttaggctaagtttcacttgccctttcgcaacacaaacctttgtccctagatctgactaagaggttaagcaatgtgaataccggtggccaggcccttcctctccccagaagagagaagaggtccccgaggcagcagatgtgagtcaagtgccttgtggtagaggaggccactggagtagacctgggaaaaggttctgacactgtttatgactgttgggctgggcttgatcagaccaagcaccaaacgcagagctatgtatgcgcagctctgaccttcctccagggaggatttcaggatgggtgctcatgaggctccactcctctatgagtatcggtaggcaggattaatggttgccccagaaaagtaatgttttcttcagtggtgtagctactgataagttgcccatgtcattgtaaataacccctcactcaggctcttgtgattaattcactggggcacatgacatcaatgacatcacacatacacacacacacacacacacacacacagagagagagagagagagagagagagagagagaataataaaaaaataaaaatttaaaaatcatctagtctttgttaataaggataatatacttggtggtatacttaaaattggtggcaaaaaatcatgcccgtaagtaagcactgtctgagggcttgcgaaagtttctaaacctgtagttacaggcatcctcaacaaaaggcatggcaagtcattgacattagtgtcacccaggcacacagccaactcaggtgggaattgttggctctgtaaggacaggcaaaggaaaaggtcacactcaaatggctcatctctgtcatccttagtagaaaaaattgaaaatgatattagtcaagaaaggactaaataagatgatatgcctaatattcagggagaccaggataatgtttcaaatgccctggaataactggctctgtgtgtgtgtgtgtgtgtgtgtgtgcgtgcacgcgcgcacgcacatgtgagtgcacagatttatgtctgaatggtcttcagaaattaggtgatattccacaggaaggattttccatcctatcaagaacctaagaatatttcaaggaaccagatcactatttagggaagagggaaggtcgtgtattatattagccagatatacttcactcagatatgattttggattacacatggtggtgcacacctttaatcccagtacttgagaagcagaggcaggacaggagacacccagggccaacgagacccacatgaatgcacaccccctcatgtgtcagtgagagctctcgcacactctccctctcataatgagaaatgagaaaaggagaaagataaaatatctgctattccttgtattagtcaaaaaacttcctgcgtttgaggatagcttcgtgtgtacttagatatttagaaagtctcaggtaaaccagtgcttaatagtttgtctcaaacaaacaaacaagcaaacatgatttgaaccaatggcattgggtaggaaggctttgggcttcagataacaaagctgaaggaaggtctgctctagccacagctgaacgtccagtcctcttctctaacaggaagtctgcaggaagttgctctccaagtccacgcagcacttccagggcgtaagcagctcagagtctctgaacttgcctgcttgtttcgctgcttcctcttccactccaggtgggaaccacggctttgagcgacagagtctcatatgtcagcttcttgaggcaggagagagagagtgataatgctagaggattgtcttcccccttcccccccccccccgccccactctgacaggaagagccttcgccaccgtgacaacctgcctgcgatcatcttaacttagtggatagaccctcagacgagtcactggctgacaaatatagacacccatgattggcttacagcatagtgttcattgcttcctttcttttccatctgcagtccagtggggaccattaaaactaagtcaaagggaaaactattcatggttttttaaaatttttttaaattttaaagagagaaatatgaagggctagggagatggctcgggggtcacgtgtgtgttgtacaagcatgaagattagagtattatcttcagcaagaaggtaaaaaacctggatgtggcaagacctgtaatcttggcactgggaggtagagaccgaaggatcctgaggcttcctggtcaatcagcatagagcttcagatactgtgagaaaaccaaatggcagagagggataaaagaagatccccggtgctagcctcatggacatgcacacaagcatgcaagaatgcacacgcgcgcgcgcgcacacacacacacacacacacacacacacacacacaatcataatgagagtagagaaaagtagaaagaaagacagtttattattccttgtattggtgaaaccctccactaaggggcaaaagctattgtacaccatgaacacctgcaggctcaacccttgggtgcagagggagaagactgcacaatgaattccacaccaaccatggagaaacataaattaacgaacaaataggaaagcaagcaaaaaaaaaaaaactagactggaaggagggattctgggtcatggaaatatcattcgccattgatgaattttatttttatgttcatttttcagctccatccctactccttaatgtcgctgccatgttcctgtgctatggtaaatctcttgatttaaaccaaaagctttccttacttcctttcagaatttcacttacgttactctctctcctctccctcacttacaatgaataatcttggaagaaaacatgtctgcatagaaaaggactttctggttagttcataatgttgttccacctatagggttgcagatccatttagctccttgggtattttctctagctcctccattgggggccctgtgatccatccaatagctgactgtgagcatccacttctgtgtttgctaggccccggcatagtctcactagagacagctatatctgggtcctatcagcacaatcttgctagtgtatgcaatggtgtcagcgttcggaagccgattatgggatggatccctggatacatcactggaaagagaggcccattggacttgcaaacttgatatgccccaggacaggggaacgccagggccaaaaagtgggaatgggtgagtaggggagtgggggtgagggtatgggggacttttgggatagcattggaaatgtaattgaagaaaatacgtaataaaaaaatattaaaaaaaaaaaaagaaaaggactttctaccttactggcaactgtaggctcttaggcgagggctctcgcctcagtcatacgcgtcttcctctctgtaaagtgagctggctaaattagacacatccgaaggtcacatagccccagttctgaaacttgatggttctaaagtctgcggggacaagcacatgacccttctccaacctctggtatcaggttctgttcccactcgttttattcattatctgctctgtcccctacttaacccagacttatttgtgcagtctctgaatgagcaagccaggctttttttttttggatgatattattagatgctcctgaatattctccaagtgctttaaatgaaaactctggacagtacagccagacttcccaagttgccaacttgtcccaggccttagaagtcacctaattacattgaattctgcctggtggagatgaagacagaaagcctgtcactaatggtgcatgtgttgagggtggtgaccactccatctttattgccagctatgctaaagcccttgctgcatcagaaggagtgtgagcttgtaaagttccgagtctgcagcatgatcttccattctctaagcggtaaggcttaatgtgtgtgtgatgctgaccagtgaaggaagattctagcaatattctgaaagtgatagataagaaatcaatactaaaatccatggctgagaatccgtctttggttaatgggtagccacagaaggtgggagagagatttctggatacttcaaggagcagaagaataagatcagccagaggggctgctctgagcatcgattgctgctgctgctgctgcccctgccgccgccgccgccgcctttgtcgtctttgtgtattttgtggcgctaaaagaatagcaagcaccaggcagcttctaatgaacaaatgcttgtgattctggaggccaaatccaaaactgagatactgacatctggaggggccttctggctgtgtctaatatcgtagacctcatgtggcagaaccacaaatggagagagaaaactaaaagggtccacactcactcttcactaggaatccactcctgcaatggtggtcgtaatcccctcaccccattctttcagctgaatcttttttttttttcatcaggttctgccgcccaacgctattgcgtagggagtacttctagcacatgcttatgggagtgtgttatcatcacaagagttggtaactttcaaggagacagtgtgagggaaggctgtagaaatatttaagaggcaacagacttggtcagtcaatgaagccagaactctaaggggaagtgtgatgctcactaaaggaaacataaaggactccacccctaccccccacccccgggtgaacagaactcttctgtgctgtcccagccttgcacaacagcaacactgataccctactcccacagtgacagaaaaggacttgggactcctatgaaggacgagggacttgactagagctcactaccttgacctttcactgttagaagtggcataaggtgaagagctacagcttaggggctggagtgatggccacttgctgttcttccagaggacccaagttcagttcccagcacccacatcaggcagctcgcaacaattacccatgattgctaccattgatgctgatgccttcttccaacttctgagggtacctgcattcttgttctctctctctctctcatctgtaaaaatcatattaagaaaatatatatttgggtttaaaatcaaaatggaagatacaggttatagagatatatttagcaaaggaaccaagaacacttgatttctgtgccagagagtcacactttcctcaaagagctcccaaggagaaacaataaaaataaatacagctcttactttgcactagatgctgttaggagcactttaactccattagctgattttgttcttataacagatgccagggcaagagaaagctgtatcagtcacttgagaattgaagttgatttcatggcaggcggtgggacagagagaggaaagtgggctggtccttacaaagcacagatgcagaaaagttacactgggagacaaaaatgagaagagatgcagagtagcctggctagctggctgggttcattcatttactcattttacctttattgagatggttagagggtaagtctgtgctcaccatagtgacaaacttttaaatgatgcttgtgcttcagccccctccagtatcacctcagtcttatcattcgaacacttggtcctgacgggctttgctttttgaccttgtacatttttttaaaaagcgatttttatttctttttatattatgcctgtgtgatgtaattgtcccacatgagtgccacggccacgggagcctgaagagagtgtggcatcttctggaactagagttacagatttgtgagccctgtgtgggtgctagaaaccaaatccaggtcttctgcaagagcagcaagcactcgtagctgatgagctatctctgtagcttccggataattattttgatgacaaatgtctacctgagcctccatttataacattgcaatcattcctagagatgtgcactagtagatttgtacaatagagtgcaaatcagcatatttcatgaagacttaaaagcttaaggtccttcagccatttggaatgggcaaactgctgggacatttataccatgcagtgttgtatagcagagaaaatgggtgaatcatcattacatgtgagtgaagggctggagagatggttcagtggttaagaacatgtactgctcttacaggagcttagtacccagtaccatgtcaggcagctcacaactgcctgcagttctagctccaggcgggaatcgaatacctctggcctctgagagcaggcatataccaccatacacatatatgcataatttaaaatgaaaataagttttgaaaacaattaaaaaataacaggatgaataaagactgaacaacatgtttgagtctatgccggggcctagcaaacacagaagtggatgctcacagtcagctattggatggatcacagggcccccaatggaggagctagagaaagtacccaaggagctaaagggagctgcaaccctataggtggaacaacaatatgaactaaccagtaacccggagctcttgtctctagctgcatatgtatcaaaagatggcctagtcagccatcagtggaaagagaggcccattggacttgcaaactttatatgccccagtacaggggaatgccaggaccaaaaagggggagtgggtgggtaggggagtgggggggtgtgtatggggacttttgggatagcattggaaatgtaaatgaggaaaatacctaataaaaatattaaaaaagaaaaaaaaaagactgaacaacaaaaacaaaccagaagttccaggagaatattggctccgcactttatcttttttaaggtccaaatgccaaaacaggtatttaggtagttgttgtctaagccatttgttgccgatttaagtaaaagtccatccattttctgtgcctgctaaaattgatacttttaaagcaagaaaatgaaacaggaggaaattcaaggtggaggatgtctcggtggagcaggagggcgtgaagagagagcacacggaagtgaggctgttgaccgtgttctcactgtgctgggcagttgagacatagatacttatttggaaaagaattaaactcgagggactcagtggaatggaaaaagtcagctatgggtggaacaccagaccatttcatgaactgggacttgtaaatgttctcattctggcacctgctgagctcctagtgacataagagacctaagctccagatttattccgaattaacaaattgagccagatcctcagatctcgtggaagaacaagcaggtgctctcgactaatgagccacctctccagtcccaaggtatagagctttgatctccatttttctttatgtacaaatatttccctaggcattaaaggtgtaatttccataatctattcagtgtatcaggctgtggtcatactgaataagaggttttcttcacagaagcatcctgtacattaaatagaaagatcaattttaaatgacacctgagcttactccagtgtctctgctaatttgttgaacttttccttcataatctctttaaattaattattaactagcccaaagcagggtggacttgggcattatagagtacctggtcaatttagaaatcgtttagtccaagtcattagaggattattacccttttttttttcttcagccagatgggggatgtcataaatgtacacaattagggttctttaaattaggcttatggcttggatgtgaaatgtcccctagaagctcacatgcttgattacttggtccccagctggtagcactctttcaggaggttggacagacacacagtctcattcatagttggtggggcatagggatgaaacttgagggttacggatcgcctctgattctgtcctggttgctctgtttccagatccagtcacatgtgagcaagctatctcacactcccgttgtcataacggactggttctgtttccatgtgtttctcatggcggtgatcgactttatcctctgaacctcgtgcaaaccctccatgactcaagttggtcctcctattaggtgtttgccctctgtcatgagaagagtgacacccatagtaggctcctttccatccatctcgcatgtgccccacggtcaggttctgttggtctaaggctgaccatcaactgctgctgaacatatatatatagttgagaaacttttccagtcatactttccaagaaataaataggagcttgagtgtggtgagctgtagctctcagctggccactgatgtaattattaatcactgcatgcaattaattgggacctttcttagacatgtttgccactgatccctgtttccagggagtttcacaaatgttcccaccccagcctcgtacctctatttgttcttttgtaactttataaaaattttaatctatacaagtttgcaatgcattgatcatatctattcccaccctcaccttcctggttatccgagattctccccaccatatccctttgaagtgtcagatcttcctcttctgctctttataacctactaagtggtgttcatatgggcacaggtgtaggaacattcaccacagcatgagcaacctgtaagagaccacattcctgaagaaaactcccctttctccccaggggacatcaacggccaataactctcagttatggatggggtaccttccgtttatcctggaatgttgactggatgaatctgtgtaagcagccactgctgctgtgagttcgttaagtgtaatggcctcatgttgaagttaagccctggatcttcctccaagctccgtgctcccggaaataaggctcagactcaaaatatatttacaaataccttggccatgtaactaggctcttctctgactagctataacttgaaataaccattgattctagcctacattctcccatgtgattggcgatatgagctcaggtaccaggcatctgtcttgtcacatcttttcagtgactctctctgcctccttctctcccagaattctttctcctcccacggttcaccttctatttcctgcctaagccatagcccatgggctttttagctgacaggtgatgcattcatacagtagacgagatgttctgtttatagccttgccatacccagaagacactgtgtcacaacagtcactccccatcctgacctgcagcccttatgaccttttggccctctctttcacagtgttccctggggggtggtaatggtggtggtatgcatatatgtcctgttttgagagcaccgcatggtcattccacatttgttcttaagtggaagaaagcatgatgcaaaacagaaggagtgagctagactttaactggatttaggggactttataagagaaagtaaaaacgtcctcaagaattcattaaaaatgaagagcatctcccccatgctcatttctgttcattacaaacgactcaactattacatgcaaatattactctaggaaaatagccacccactgatatgggtgtggagatctccaaagacaagaggaagttgaaaagggctcagatggctcctccaatgtggccttccagcttatgacaagagaaacacaattgctggtccagggacagatgtctgctgcacttgctttgttcctggctctccctctgacccaatttacagcccccctgcagctgtctcctgcatactttcccacgtgaagttatttatctttcttaacagtcaactcgatttattccaagagaatgctcccctcccccagctctgctggtaatctattcctgcactaaattgccattgtaatcaaaattcctagaatagtttaagttggccttctgcagctgcagtcacctctgtcaaagccctggccaagcctcctcagtgccctggagtgagtgtcattccacattgctggaaaccacaccccatctggctcttcccgcctttccaggctccttttgctgtgtccttttatcatctctactgaaccactttcctgacaaagctccaacacggttcctcctctagagctaccgacctcttcaactcctatgtggtcatttttttttctgtccttggccatttcttaacccatttttttaggacatcctcttctctccttgaaacttggtcagatctgccaccatatgtaccacttactcaatattttgatcccggagctcagttccgtggtggctaattttgtcaacagacaacatctggaatcatctaaaactcaagttgctgggcacttctgtgaggcagttttttaaaatcagattatttgaagcaggaagacacatccgacatccgggccccactttctgatggcagcccagataacatgacgtggaagaaggacacttggcttttttttttttttttttttgcctgcttgccccactgtgtctggcatctctcctgttgctcaggcattccttcactattcagaatcccaacaaagatagaaaaccatctgctctccaggaatcctccaggatcccagagctaggtgaggactgctgagacacccagccttgtggactgaacagctgccagtttagatattggtctttccatcatgagactgccattgttgaactactcggaccatatcctgtaagccagccttataaatgcatacacacacacacacacatgcacacacacacatgcacacacacacacacacacacactcacactcacacatgcacgcacgcacacacacacatgcacacacactcacaaatgcacgcacgcacacacacgcacacacacacacacacatacacacattcactctcagttctgttccttcagagaagcctgactaaatcaggttcccagcacctatgatgggcagttcacaatggcctgctaatctagctctgggagatctccttgcttcttctcatctctgcaggcactgtactcattgtgcacacataaatactaatactaataataatagtaatgaaaattataaattcatatgcataccagtttttattagttggcaacagattgcataaccacaacaccacttcacaaccagaaaattgacagactatactagtcatatccaggtttcatagttttgccctgtgcttagacatgcatattttcagctattcattgattgcttgccatactagaaactgacctacacaggctaagccagtgctctaccgctgagatgtatccccagccttctggttccatctgacttaagttgcccaaggtagcgttgatcccaatctgtaacacaggcatacctgaaacttgcaatccttctgcctctgtcacctgcgtagttgagattttaggccggtgccactctgtctgtaactttgttatgtggagagactcgtgtgcctctctatgagatacacttgggaagaaagaacctgccggttaagggatggcctccatcaggttgcctatggggatgtgtgtggtaccttctctgtccagtttactacggggagcatcttccctaggcaggtcgcttaggttgtctaagaaagctagctgaacacggagcaaaccactaaagggcatccctctgtggtttctgctttaaggtcctgctttcaatctgtctcctgtcagatgaaacaaaccctttcctctccaaattgcgtttggtaatggtgtttatcatagaaaaagaaaaccgagaaaaagaaaaccaccatagtcaaacttagactcgtcccatcagtggcctcttgtgataccttttagaaccaactgccacctgtcccttctcccgacctgtgaccagcaataatatgtctccagatttatactttgattaattttaagaatgttgcataaattttatcaaacaccatacggaagtctgaaatttccctccccagcatgattctcttgatatccacctgagttgttgtgtagaccgacactgttctcattgctattggtgagtagtatttctgaatgtggacttggtagtttgtctaattgctcgcttgttgtgagatgcttgggttatttctagttattgaaaatcaacatatatgaaaatgcatatgtagattttgtgcactttcacttctcttggataaatgccttaggaaaatgttttctgggtcatatggcaggcatatgtttgatttcctagagacatcaatgcagtttttagactgattgtcccattttacattctcagtagctgcgtatgagtctgacatccttgccagtgtttgttgatgtccttaaattttttgaaccattctgatagtagggtaggatctctattttatttatatatgtgagtatgtgtttgtgtgtgagcatgcgcatttgtgcatgtatgtgtgtatgtgtgtgtgtgtgtgtgtgtgtgtgtgtgtgtgtgtgtgtgtgtgcatgtgtgtgtggaagaccatcctcacccttggagctggagttataggcaattgcgaaccacatgagatgggaagtgaactcaagtcctctggcagagtcctctgtgcccctaaccactgagtgacccctcaactccttagtgtatcatactgtatgtttactgagtgtttctatgatggcttatgctgttgatcctcttttcatatactactttgtcatctttatagcctctttagtggcagatctgtcttttctaagtttcctagtctaatattttaatcactgagttttgacggttctttatatgtcttagatagtgccaacctccactctgtttagatgagcagaaggtctatggggttaaaaggctttttcagtcatttagcaaccgagaaaggaaagatccaagtctgcccctgtctttatgcagtctttaccatggctcatctcatatgtagtgtcttcccaactcatcaagctacattcatcttagcatacatagtctcccaaaccaaaaacccataaccagggtatacatccttttggtggggaattgtctgaagtttgtcttctaaagtgtccagcctgtgttagtcattgtatcgccctatatagtcaacaggggtggggatggaacacaacacctaagtatccctttagccccgaagagccttcagttgtcactcctcatcaaaactatttaactagagtcatctcattcaaattcaagtccccttgccagattaaaatatagctgatgagtagttatcatgaaggtaaagaagccagtcacacggctagggagatggtcaatgggtaaagtgcttgacttgtaaaccctaggacccaaattcatgttcccagcaaccacataaagtcaaacgtggcatcttgtttctgcaagccgaggtgtgaagggtgaagaagtgaatcccagggacttcgggtgggtcaatctagttgaagcgatgagttccaagtttagtgagaaacaacgtcaaaaaataaggaagaaagaaattgaggaagacattgtgatatcatcctctttcgtgtacatgcacatgggtaggtaagcacgcaccactcacacacacacacacacacacacacacacacacacacacatcaattcttcatagctctaagtggattctttttgtcaaagaatcagctgaagcttaatggagattgcatacctgagctcttgtcttctacagggattgtaagagcaatgcccagatgactcttatgtacacagctgtcccagagtctgttttctaatcactcagcctgtgaaaactggtgccatccatgacttgaacaggctggtggtcttgggagccagatcactttcccagtgggcactgaggagctccacctgccaccagatagcagagtactgattaggccttgaaccagaaatgaccagaaaagcatgttatagatgagaatagtacagtggatgtcatgttctaggtgtctgagaaatatggaggaaaatgaccctaatcataaagaaattatagggtagatattaagcacgcctaaattattaaccagacaataagaggacatgagagattaattgaaggttaatagctcattgtgaaaggcaggggcctctctggtagcttataaagatgctcttggcttttgcaacctgaggcctgagaaattgtggcctatgacttaatagtaagaatggtggaacaacaatgaagggttaagacctgaagtgaggccatgtcataagttgttgggccattgtcctcacccaggttaggaaacaatggaatttgacacatatggcaggagtggattatgtcaaaaacaataaaactgaattgaattaactgtattggatctagagttgttttttttttttttttttttttaaattctgtgctgtaagcttccagaaaaggcatactccttcctgttaaacaccagtgctcttctgatgtatcaggactgtattagttacctctctgtgactgtgagaaaacaccatgacaaaggcaatttgtagaaggacgggttttactgggttatagttccagagagataagagttcattatggcaaaaagagaaggctggagataggtatgggagctgagcaggaagcgcaaaggccaatggcaaacatgaagcagagagaacaaattggaagttgggtaaagctcaatgcttgttgttagtgatgcacttcctccaggaaagttatagccccacactcccatcgcctctccaaacaattctgccaacaggggaccatgtgttcaaatgcctgtgggagatagttcacattcaaactaccacaaaaaccatacagtgctccatgagttaggaaaacatgcctgctttaccagattctctcctggtcaccaagctaaaccctaaggatatatcaccacaacctggcagaggactgagcttggtctggtaatggaagaaggtataaaccaaaaggaacatcaggtcctagccattaccataagtgggactggattgtgtaagttttgcctcaaaggtggcattattctaagttagatgatggaggatctgtttcttgaggcagggtctccttggatacaggagttaccatctatcaagataggataaagctgtggctggcatgaatagaatcatgatagatgatttaaagcctatgtgggggatggaagcagcctcccctaaagtaaaagtggaaatgcattattgtcattgctatggatgctttctgggcaataaaagacagtgggatatgacatacagctagaagtcttatttaataatttctattatgatgctataatgcaaagcatggagatacggacagatacgatgagtactggtataattaagaaattcagcagtaaatagctcctgaagtcatttctaatcagagatgtcattgtggagattgtggagattgtggattgtgacacagataggaagatcccaaattaacagccgcaggggttccatttcaaacttagatgccaggtgacagcatttaccaaaacagaaggtcaagtgcaaaagaacaatcaggagatctgactccaagataacaatggcaattgtcaacacagcttcctagcgttggggagaaaagagatgtcaagagacaataaaaccattgcacgcaccagagcaagaggagccaagagtgtatgagcaagatcctagagacaaggtttctccacagtgtgttctgtcacccaggttcagagctggcccagttttcaaacacagaacccaacgatgaagtgatcaggtgtcctggaaaaaaaaaaagatttcttcaaaaccatggtgacttaacaggtaacaattccctgacacttccctgaagcaatcttcaatcaccaactcagttagccataagttatgggaatgtttggttccaaacatgtcaacctgacacaggatcatacacagattcaaagtatcaacatgaaccttctgttacactgggagcacacctggccatgaatggaagctcagaacagtttcaggattacaatgtgtccacagagtaggtaggctcaaccagtgatcctctctcctgtcccagaatgtaacattgaagaagtgcacttggcattgggcccagcttgggttcctttacctgtggatgaaacttaatgagggaaacattaataacattattaacattaataacataattaaaacataatgaggggttggacagaagcaccaatgagaaccctgttgctcaaatctgccccttacaaaggtataaaatgtgtgttctttctttgttctgggtctctcctctggcctgcgtgctgagaggggagtccccaacatgttggatcaataaaaatccaataaggccacactcctaatagtgccactccctagcccaagcatatagaaatcatcacattccagtctctgaaccccagaggcttgctcaaacatatgggacataactaaacctaacataatgcaaagttcatttagtccaacttccaaagtcctcatagtctgtggcggtctcaacaatgttttaacttaatcttttaagaccaaagttcaaggtctctactgagatttactcaatcacttaactgtaatctccaaagcaagacaggaaaccaaatgggtaaactccaaactttggatcttcatgtctgatgtcaaaactctcttcagatctccaacctcttttttatctttgttgactgcaacaaacttctttctcttgggctggttccactccctgttagcagatttcctcagcagatagttcatggctctggcatctcaaacatcttggggtctccaaggaaaattcaatgttacagcttcttgtttcaatgtctgggatccacacataatcttctgggattctccaaagggctggtgtcacttctccagcactgccctcggtggcattctaagttcagagtgatccactccactgttgctgctgttcttggtgatcatcccatggtactgtgttgtgtctgctcttgaccagcaagaaagacacaacggccagattcttctcaacagcctttattgcaggaatgcctcaatgctgctacagggacctagggaacccagggaggtctgcttatatactctccagcacagggaaaggcttcatggccccctgggattggtcagtctgccggcacctaatttgcatgcacccgctccggaggggttggcgccagactcggacttacatctgcgctgatgttgtttatgacaatggcacacctggtgcccagagccatcttagagttggcttcctacagtactggtatctccaatactctggggccttctactgcaacgaggcttcaccaataacctctcataggttctctccatggtgccaagcctcaacttcttttcatgaccccttcagtcctgggctgtcaagtgcaactgaggctgcatcttcaccaatggccttccatggcctctcagagtgccaagcctcagctgctctttatgttcccttcatcccttcaaaaccagtaacacctgagtgatggggatggatgtagatgaggtgaaacccagaacacctctcattccctgcaagggaagacccatgcctgtagccagaaatgttaggattagagcaaaacccttagtagaaactgctgtgattctcatttggaagaccatggactgatctgtcagcagtgttattggaggtagcctttttctttctccattgtgaagttgatggtccttgggcagacttcaagaaagggtctgaggagacagacccaggaagagtgtagcaataacatttgatttgcgattaagaaggctggagtcataattagccctaaatgggacaactctatcaccctctccaatgctcagggaagaggagacagaaagaatgtaaaagccattctgggcttgacatagctgttgtcttcatgtggtgacctgcactagagctgcaggcgactgggcattcatcaagtgtgtgggagggtcccctgaggccccacccctcccttcaggactaacagaagttagtgcttgccaagggagtagctatcatcctctgcagtgacacggaagctgacaagttacccatgctccaggaaataaactcccacccacgctcaggcaggcgacttaccttagactgagtaagtcacacacaaaagaagacatgaaagaaggaggggctcttcgttgagactaagggtttcaagtgggagaaagagaaggataagactattaaaattcattacatacaggtatggaactgccaaagaagaaaatgatgaagagcagcagctgccgccaccgggagtgagtcagaggtggcctgcaagcctgcaggaacctggccctcaccaacagaaaaggcggaggacagacacctgacaagagtgttctcttccctccactaagtgtcttttacagtttacatgttgatttgggagactgttaattctgggatatgcggggggtggggtggggggaacaactccaacattctggaccaaatttaaagcaacctttattaaatattagatattgaccaagggatggaccttagttgggaccatttcacagaacttcccacctgagaatggcctgagccatgggttgcaggggcaaagggcaaacctataggccactgtactttcccatgatgctttgctgtttcctaagaactataattcccagcattgcaggaagttactgggtttctgggcaggtaaggcttacaggttaattttgggcattataagacaaataccaaaatattatctatgatactattgctttattttattttattttcaattacatatgcttgtatgtgcatgagagtgcaagtgcccacagaggttagaaggaggtattaggtatcctggagatggagttacaggagattatgagctatcatatagatgttggaattaaacctcagtcctctggaagagcagccaatgagccatatctccagccctatcaacctgttgggttgtttaaaaataattcttttatttttatttttaagtatgtgtgtgtttgtgtgtgtgtgtgtacatgggtgcagtaccctaagagaccggaagagaacattggattccccccccccccaccgcccccacctcccgagctggagttacaggcagatgtgtcccttggaaaccaaactcagctcgcctagaagaggactggactatcgagcctaagcgcccatctaagtctttgtatccagtctttctgcaaccctggaagcctttttaccaaaaagtacattctttcatcctagctgttttttgtgactagcacctgctgaaaaaaaaaaataagaaagaaagaaagaaagaaaaaacccaaaacatcatcaaaacaacaaaaagccaagcccaccaacaagaaacggatatacacaaaagccaagaaaaacaaaacaagcccccccaagccccagctattcatcaagataggaaagagaaacacccaactcctacctgcgcttggtgattgcttggtgaaaaataaaagtatttttcctctcattccttcttttgtgatcaaatgaataatgaagggattgagcctttgctagtgtgcatgcccctgcagggagccaagaaacaaataggtttcctaagggtataacccagccttttcggcttttccgtcatcacgtgattgagggcttctgcttcccacttaacctgcatccttcccagactgattcatggaacctcaagggctctacaggaaaattcaaacatcagcttctctctgccataggacttccatccgaaggaatggttccttggttgttgccttcacagccctcacatccgggctggacctggcagaaagttgacatttgacccctatctagagcatagacgatgctggcagccgtatgtcctcacttttgccattccggtgcctccctcggggcacagccaaggttccgagatgggcattttcaggaggaaacgattttatttgaggtcttggcagggagatgagaggaggaggcgtgccaccttctgtaacaaaaggcatttcccagccttagacacacccttaggcccagatgtacactcccactcctgtcaatccaactgcactgactagcaaccctaatgcctgctgcttccaggcaccccgcagcctgcgtcttgtttccactatttcctctgcctgtcgcagggaaagcctcactaccaagagccttcaaacacagttcctgttactaattttgccccaaagggtaccacagtgattaacttaatgcttccccagggatgactctctctgtctggggtcagggtggggctggatggattttctttattaaggatggtgggaaccctcttttgagctttgaagtctcgccttagatttttttttaattttattttttatttttgataactacaaagggacaggaagtctctttttactcctctgaggcttgctgttctccaggggcatggaaaatgtacacgttgttagccccccaagcctgggggctggggcccgcgctctgccggattgtttttatatcccagcaaaaagcatctgtgtgcagaacagcagctggtctgctgctgccaactgcacgttcccagtaccaatgtaagcactttccttagaggttaaaacccccaaggcactgtttgtgtttggagaagaaatgctctaaaaatagtaagtgggggtttaaagtctcttcgtcagatgttcggaagcacgctgacctggtgcgctgcttcttagaaccagagctcattggcaggttgctgtgccttgcacctacgattcctgactccttcagtaagctagctggtgaagagctggagaatctgtatttataataaatccccgggtggggcattgatgttgctgattttaagaacacacactgttgtagccagtcaaaagacccttactcagaaagaccacagagaccgccgccatcgctgcaaaccgcatgaggatttttattgatccaacatgttggggacacccctctcagcacgcaggccagaggagagacccagaacaaagaaagatcacattttttatacctttgtaaggggcagatttgagtaacagggttcttattggtgtagcaagtaaccctttcaggcattggttggtttgtatagtgactaagtaaccctatggcccagtgactactttgcttgcccccatggtgggttattatgatttggtcagcaaagtaatagtactttaacatcacagctattaacgtcaagggaattctcacaacaagctcagggtggtttgtggtctttgtcagaattcagtgtggggcaggggtcaggagaattgctaatcttgttatggttacttctctgagaacagctagtattgttttggtagttgcaagcttaatcattttgaccaccaaaactatgtttttacatttgtttagtcagccggcttccctatctggctctgcacgtggcctgcaagtacagtttggaaagtgtttttcgaaggaggaaggtactgggtggtcttgaattcattttggatattacaacacaaagaaccactggtctggtgtatttccccccagtctgttgttggctgcagggtgtaatacagacacagggtttattaccagggagaggagggtaccatagcttgatgcaattccttattacctgtgtcgccaagagcaagtagcttaaccttgctggtctctgtttcctcccttccttgacaatcatttctatagagctaatttatatcaggatcttaattatcttgttttgtggagggcacatgtttataaaacgttgatctttctccctaccaatattttttctcattgtcatttaaagagtcagttttgggactgacaagatggcttagtgggtagagaaggcttgccaccaaccctgatggtgggagctcaatctttgggactcacaaggaagaaggagaaaacagactctgatctgtacacatttaaattggcacgtgagcccttctcctcaaataaagtcacacacacacacacacacacacacacacacacacagagagagagagagagagagagagagagagagagagagagagagagagagagagagaaagatacacacacacatcccatacacattttttggccaggttagacaatgctggggaaagatatcagatttatgcatctctctctctctggactgagttggtgactgtgggaagggatgggacttgactactgcaacttgtcagagcacagtaggccactgtgaattgcagctctcagactcctggtaccatcccatagtccagcacatgggagctaaaagtccaaataacaacaatgctgtctgaggacttggaggcaggtgacattgtggtagggatttgtggatttcgatgtgtgtttgttctctgtttttaacaccttccatcagataagttcctgtcctgtttcttcagatcccaacctgttttccatttccttggggagcctttgaaatatgtggctggatctggatgttatgaacttgtatggagttctgcacaagtctttatagtttcatttgattgcaatccaattaatgtaaggatcctccctgaatgatgcgccctgtgaaagcaaactccatgcttaatctcttccctatacttgtgtagtatgcatttcttgacttttcatgagacattcagagactatcctataaaagtgtgtaagtcataaaagtgtgagattaaaaaaaatagcaggtgcaaatgaatcacattttcttgatccattctttgggaaacatctgggttgtttccagtttcttgctattacaaatatagctgctatgtacctggtagaacaagtatccctgtggtatggtggagcatcttttgggtacacgcccaggagcggtatagctgggtcttgaggtagaactattcccaattttttgagaaatcaccaagctgatttccagagtcgttgtactgttgtggccggccagcagctcgcaacgtgaacgtgactgagatggccactcgagctaagggaggaactagtcggggagaaagaagaaacggagccaagacaagttcatcctgttcaaagctcaattttactagttctgacattcagttataaaggaagggggagggaacccgattcccgccaactggtcttggagtccagtagcagggtgaacacgtgtgtggctccaagcagcaaagcagcacggtccagcagtgggcgtggcagaatgaatgagcgggaaactccacccctgagccagcaggttccaggctgggggtggggaggctgcagttgtacaagtttgcacctgcaatggaggaatgttctcttcgctccacatcctcaccagcatttgctaactcttgagtttttgatcttagccattctgatagatgtaaggtggaatctcagagtcattttatttgtattttccagatgattaaggacattgaacatttctttaaatgttcctctgacattaaagattcttctgttgagaattctctgtttagctctgtactctattttttaagattggattatttgttttcttggtgtttaagttcttgagttctttatttatcagtcctctgtcagatgtagggttgttgaaggtcttttcccatcatgtaggctgcctttttctcctattaattatgtcccttgcattatagaaggttttcagtgtcatgaggtccaatttattaactgttgatcttagcgcctgaaccatttgtgttctgttcagaaagttctcttctgtatcagtgcattcaaggctatccccactttctcttctattagttttagagtatccagttttatgctgaggtctttgatccacttgcacttgagttttgtgcaggatgataagtatggatctatttgcaatcttcctcatgcagacatccagtaggaccagcacaatttgttgaagatgctttcttttttccattgtatggatttggcttctttgtcaaaaatcaagtgtctatacatgtgtgagtttatttctctgtcttcgattcaattacattgctcagttattaaaagcaaggacatcatgaagttttcaggcaaatggatggaactagaaaatatcatcctgaatgaggtaacccagctccaaaattataagtagatattagccataagtatacatacaggatacccaagctataaaccagaaacccaattatgctaaataacaaggagggctcaagggaggatgcttaatctcactgagaaagtgtcctagtcagggtttctattcttgcacaaaacatcatgaccaagaaacaagttggggatgaaagggctttttcaagctacacctccacattgttgttcatcaccaaaggaagtcaggactggaactcacacagggcagaaacatggaggcaggagctgatatagatgccatgaaggggtgctgcttactggattgctcccctagcttgctcatcttcccttcttatagaagtcaggaccaccagcccagggatggcatcacccacaatgagccctcctcgcttgatcactaattgagaagatgccttacagctgggtctcatggaggtatttcttcctcaagggaggctcctttctctgtgataacttcagcttgtgtcaagttggcacataaaaccagccagtaaaggaggagaaacaaaatagtcattggaggggatggagggaaggaactggttgagagaggggctggggagggaaatggggagttggtcatcaggtgtagggagagaaggggaaagggggctgtgagagtgaatggaaatttgtggcaggtgggagtggggtgggggtggggaggctgccatatcatttctaggatgtgtcagagacctgggacaggggaggctccaggtagactatgaggggcctctagctgagattccttgtaatgggggatatggagtctgaaatggtcacttcctgtggccagacaggacctcccagtagagggaaaaggataccaacccacccacaaaacctttgaccctaaatttgtcctgcctacaagaagttccgggacaaagatggaacagagacaaagggaacgaccaaccaatgaccagcccaacttgagacccgtgccgtgggcaggaactaatccttaagatttaatgatactcttgttatgcttgcagacaagagcctggcatatctgtcctctgagaggctccacctagcagctgactgaaacagatgcagagactcatagccaaacattagacggaacttggaaaatgtggaagagttgagggaaagattgagggacacagagaggataggaactccacacgaacaacagagtcaactaacctggactcttgagagcttccagagactgaaccaccaaccgagcatgggctggaccttggcatcctgcatttatgtagcagatatgcaccttggtcttcatgagagtccctcaacaactagagcagggactgtccttgaccctgttaactgcctgcctgtggatcctattccaactgggctgtcttgtctggcctcagtggaagaggatgtgcctagtcctgcaatgatttgatgtgccagggtgggttggtacccagcacccccctcaaaggagaagaggatgagggaggagctatgtgatgggggtactgggaagagaggagagatgcaaattggaagtaaagtgaataaataaataaattaattaatggaaaaaagtagtgggtgctatgaaggagtcatctatattagattttctggagttataacaaaatacttgagagaaatggagttattttattatcgttttggagataaaagtccaaataacagtagtattatctgtggtaagaactactgtagatggcactgtgataagaatttgtcagttcctatgtctgtaaatgtgtagcgtgtgtgtgtgtgtgtgtgtgtgtgtgtgtgtgtctgcatgtgcatgtatgtggggtgtctatgtttgagatggatatggatgtgctgtgtgttatatgtatgtgtgatatatgtgctgtgtatgtggaagttatgtgtgggtatgggtgggggctatgtgtgaaagaaagagagaaacaggatagggaaaggaagtcagagccagacctatatggggacagtaatgacctccttatttagatttatctcttaagggttaaagatgacattattttttaacattgttgctccaggaccaggctcctaatgcatgcagtctgagagacacattcaaatcatatcctatacacagtaccatcctttggccagaatattggtaaaaccatccaaatgttagaggagagtagccaacagttctggcatccgtatacagcactgccggcgtagagtgccctactgccctgaagatgccctgtgatttcattgaaaattctttccagattggtaacctctcagcccggctctctgtgccttatagatcatgagatctgtaacatacaacgtaacaattagcttctcagttcttgttggagaggctgggtttataagaaagaaagcagccaagcacatcagcccacgggagcctggcataaagtgtacctcagcagttccttagtgtttgtagaataaagtaatgtattatagctttcctatagatccacatggaagcctgagaagctatgtggttctcctcagacctcatagtctgctcagattcactcacttgggcgggttgtatagctctggggaagatttcacttctctgcctcagcaacacaggctcaggcgcatcctgctttgggttgtgaagttgaccggaagtgacacgtatagctttcagaaagaagtttgaagagccagcatgtgactgaccattcgtgcccttataccttgttttttccaaggattatgatagagccacaggccattgggtgctgatatttgttttcatggtgtaactaaatctgtccgcagagcaacacttcttttttatgaagataagaagtaactgaggcaggtttccaatctagacatggttactgtagggtctgctacttgctagcttcacccagctgaatcaagaagagaaaacaactggccaagcttgttgggggcatacatgaaagtctagtacttaggaggtggaggcaggaagataaggagtggaaggtcagtcttgggtgcatttgtgtgtgtgtgtgtgtgtgtgtgtgtgagagagagagagagagagagagagagacagagacagagacagagacagagacacagagagagacagagagagacacagagagagagagacagagagacacagagagagagagacagagagagagacacacacacacacacacagagagagagagagagagagagagagagagagagagagagagagatattccctggaatcaggctcccattacaagcactaacaattccatctgatgccttgcaaattgtttcagaggcctgggaaagataggaaaattttctgcctatttttagaaagccaatgtaacattgtaccaaaatcttataaagatagcattgaaaaaaaagaaaaccaacatccgatctcattgaaggagtaacaaatcctaaattattaaaataataacagttcagcaaagcattaaaatataccaagtgaagtccccttttgacaatcaacaacggcaccttaccccacacacattatgactgactgtgtacccctctaaaataggacgaagggggaaagaatgcattgcttcagaaaatgacccagcaacatatgctagttatctatttatttttcttgccttgacagaagctagctagtattatctggaagcagggaacaatgtctgttgagaacctgcctctgtccggattgaactgtcacaaggcaagtctgtgaaggcattttcttggtttaataattgatgtggtaggtccagccctctgtaggtggtaccacactgagtgtgtggtcctgggtcgcagggttaaggaacctgaacatgagcctggagaggaagccaggaagcagcactccttcatggcctctgctccacttcctgctttgagtttctagcttgaattctcttcatgaaaaattattggctgggctggcgagatggctcagtgggtgagaacactgactgctcttccaaaggtcctgagttcaaatcccagcaaccacatggcggctcacaatcatatgtaatgagattggacacgctcttctggtgtgtctgaagacagcagcagcatacttatttatactaataaataagtctttgggccggagcgagcagaggtcctaaattcaattctcaacaccagatgaaggcttacaactaactatctgtacagctacagtgtgtaatcatatacataaaataaataaataaatcttttaaaaattgaaaaattatttggtgtaaggtaaagaaacaaaaacccaaacaccctttccttttcaagtcgcttttagtcgtggtgtttatcacaggagctggaggccatgtaagatgcgtaggatgtagcatttagaagccatgtaggacacctcgtttagtggagctaagccactagtgtgatataagagtccgacgttaatagacggctttaccaaggaataatgaattctgtatttcaaacggagtcgggattggcttagggttaaaaagaacctagaagtcaaggttccccaggctggggtggctctgatagacgagtgccaagcacagctgcagatagcgcaaaagtatgacttaaaagatacatgctataaggaagaaaagtgagggaaaattgcaaaatatgaaaatagcaagaaatttcatgtatgtatcaagtttcccaaacaagggacaggcacacagtcacacagacacatagacacatagacacacaggcacacagacacacagacaggataggatattaagcactgcattttgttcctcttgttgaaaccctatgtagtttcattatgtaatccaggctgtcctccgactcatgctactccggactcagtttcccaagtgctggggtttcaggcacactgctaccttgtcccactgaaagagttgtgcctgagatggtcattacttagtgaaggacagtgagacttcagcaatggagatggcatccttgttagtggatttgtccacttaaatgcattagacaaagtctggcttatcatttattattattgttattattattattattattattattattattattattattttaagcatagagttagtgattactcattcctatactttcctattgttaaggaaaaaaatctaaaatggcaaaatcacaatgtgaaatacatatgcaaagatcttaaaaccaccagtccgtgagtaaaccagttccttttggagacaaaggaataggcagtaaataagagaaaaccacatttgttaatggatgggtagttgttcactctagccatggagacactgaatcagcactcgacacgattcctttacatacttacagaggacattgattcgtttctattgttactgagtagctccaacttcccaggtcacaagttgccaagagcagccaattattcttaagtttcaatttgttgaaaaaaaaaaaagccctgatagcattgatgttcatccccgagcaactcagtaactcagtgtgtgtgtgtgtgtgtgggggggggtgtgtgtgtgtgggagggtatgtctgtctgtgtgtctgtgtgcatatgtggacatacatatgccatgtcacatatgtggaaatcagaggacaacctgcaggagttagttctgttcttgaaccatgtggggttctgggaattcgagtcaagccattaggtttggtgtcaagagctttttcccgttgagccattttagcccatagaaactggttctaccacaaacatttacaagatacaaaagctaaggacactgcttagtccatttaaaatgatataggtcccaaagcttcgcttactgtgggattttctcctatcatctcatccctttctttcatctggtctttaggatccttttctgaaggtgtgaagttggtagagaagcctactgtgtggacaggaatgtctctcaaatgcatcaccattttgagtagtagtgattgagaacaaagggaattgttgtaaggtgtggagttatttgataaggtgtggttgtaacaaagcaccaaaactgggccagggagatagcttatcaggaaaagcacttggtacagcctcctgaatgccagagttggatccctggagtccacagaaaaagccgagtgtggaaagccagatgcagtgacaggaatttgtaacttgggcattcctgggaagagatgaaaggagaagatgggagaatggcctgaagcttaagggacagctatgggatgtgtgctacaagaacagaaactagggagactctgcctcaaagtggggtgggaaccaactacacacaggtatgttcaagcagacaccacacacacacacacacacacacacacacacacacacacacacacacacacacacacacattattaaagctgataacagcttttagactaagtagaaggaaaaagagataactgtagttaacaaaatctaattcccaatttgctacctacattccctacctgcagtatgctaactttaagagggaaaaagtcctccaaccagagtgtatataaaatatgttgtctgatcctcccaatagtggttttctaaaaggaatatcatagaagatatttagaagacttccttttacgttactttttgagacagggttttatgtaagccaagttgacctcaaactttgaatcccacttctctacttcctgagagctacagctataaatatgcaccatcatggctggtttacatggtgctggggacagaacccaggactttgtgatgctaggcaagttctctaccaactgaggtcgatccccagccctcagataacattgtgtggcgctattctgtctacccaagagagtttatagtttagacttccagatcaagcgaaataaagagttctggggagatgtccttttgcttcctagtgtaggtatagatgttacgggatggcaggatttagtcagaggaagagactcaacttctctgaaggtcttactatgcatacaactttctgctatggttcttatcctgtggcataaggacatcccctgccacccaattttacatgccacatcccaaatcattgtaacgaggcttcacatggcaaccagcagttgactgcaatgagacttccatggcaaccagcagttgactgtaacaaggcttccatggcaaccagtagttgactgcaacaaggcttccatggcaaccagcagttgacacctgccttgctctggttttgttacagctgaactgtttctcatctgtgaaacccctttttaaaacatgtattcatttatcttatatgtgtacactgtagttatcttcagacacaccagaagaggacatcagatcccattacagatggctgtgagccaccatgtggttgctgggaattgaactcagaacctctggaagagcagccagtgctcttaactgttgagtcatctctctggcacccccgctcccatgaaacccttttgcatatatctttttgtcttctagtcttgtggtccacaagccctacaagtcacttttggagttcttccttagccccactcccacattcttgctttggattatcttcgacattcagtgctctcagggcagctgtgaacctccttgaaaaattttctctcttgtctggtctctaatgatgtgtagacttgacttactaggggttcatgtcttgctctctctttcatgcagttcaattcatatttagcatcctaagtcagtgactatagggaaaggttttgagcccccttggaagtctctgctgcaagcatagatcttgcagagtagatatttaatgaactcttattaaatccatgcatgaatgaaactcttcatgtgtatttcccaatcttctctctacatcattgaaaggggaataacagaatttaaattcttcacaattcctgcaaagggagacttctactaagtatgaaatgtgcaaggcttgaatttgtaatgaatgtctgatgtaacccagcattcccagaatcaccacttgggttttccacaagggtatgcattcctcttttatacaaatgcatggagggggaggggttacaggataggcagaaatgaaagatatttgttaattttctgttattgtgataaaacactatgatcaaggaaactaatcgaagaaaaaagtttatgtggggttatggtggccgaggattagagtccatagcttgcaatggaggttgcaggtaaccagaacagaacaggctcacatccctgtcttcaagcaggaaacagaaagcatgcggagtggtgtaaggcattaaacctcaaaggccatcccacaggtcacacttcctatacctccccaaacagtgccaccaattgggaaccaaacatcagagtctgtggaggacatattcgttcaaaccaccaccacagacaagtagtttattctgtgcacccttcttatggaggaggctgacaagtaccactgtttacacacagtaggactgccacgaacaatatagccatactcactacctgctttcccggtttgtggccttcccatacctcacagaactttcttcttcctgcctgtacatttcactgctgtctcttgctgtggagtggggctctatatgtgcgagggtctcagtgtgaagcaggctctgtgctacttgtcttatcctgagttacagagattattttttgtcccagtccctatcaggagtcactattttgagcccaatctggtagctctggtttcttctttccagaatattctgagtcgcgcagcctcaaaccggctctgcctttcctctacatgcctgtgatgacgactgcctggctgcagatgctccgggtgttttcccacaccagtttctcttgttgtgactccatcaaacccaggtcagcttctgtaatcgagacgatccacttaattaactgtaatgaggctcccatcatttccaataaatttctttccaaaacaccacttgagaggcacatagcttcctatcagctgtaaattttttttttcctgtctatttagttccaggaattgaatttactcagagatgtcattgcccaacctcatgtctcaatgttttaaactaaatctttcagtctggtgctatgggctacaggacccaaccccagtttcccttgtacagaatggaagatgccgtgcaaacagcttgtctgggtttcaccagagctgggagaatcagtgctggttttcatggcctcttctgcgatcagccccttctccaccaacagttttgttagttagacagagcaacttgcgcttgaagatctcaaaccatttatcgaagcatgccatcttctcctttttaaagacctgaaatgctgttggaataattttgctgtgttttataaaaatatagagaggattaatacgtttggtagaggtgcaataaggtgtggagggaaggggtgcctccaaaggcctgtgctgaggcacctcttccccctgagcgaccagccaaagaatggtatagtatagaatagagtttattcatggcatggggaggggagttgagagagtagtagagacagagaaagagagagggagagagagaaagagagagagaggggggggagggagggaggaagggagagagagagagagagagagagggagggagagagagagagaagagtagtagaggctggtcatgagcatgtggagagagagggggaggggaatggggaatgggggagcaggagggagaggacagagtcggagcaagaaagcaagagagaacagaggggctaagcagtcccccttttttcattttaaaaattttattagatattttctttttttacatttcaaatgcttcctataccctcccctcgccctgctcccctacccacccatagcagccccttttatagtgagtcaggcacacctggctgttgccaggtaactggggcagagcctatacaaaaatgctaacagatttgtcagtgaaatgatattttgctctttgacttatagaagatgaaaaagaaaaccacaagtttcatactgaccctttggggaggatacatctttaagaaattatgggagagaatagtttcatttagaaagaatttaagtgtttttttttcccctctcagacatgtcatggtttaatatcagttatccaatttttctttgtgctactctcagaattcttcctgagaaattagctttaatcttctgctttgtttcaaagcctgcactagattaagcctcgtcctctctctctctcctctctctttctctttggcttcattcgggaatgactaattagccaggagaaattaaatttacaaattaaacctctctgcatagattttctcaagaccccagccctgggggtaatatccatggcctctcctacagagcttttgcctcccagagggttgtatagaggggtgaaatgtttatgaagccacatcggcttgaagagcaggttggtggttggcggttggcagcattataagttgttctttggttccttcagggaaaaacttcagtgttccaaagttcagggtcatggaaggagggtgaggaatgttcccagccagagaagaaagtgatgtgtgtgagagagaactgccgagaactgtagaactgaagtttccaccgctccaattacatgcctgaatgccttcttttcatttcatctctgtttattatctttgtctgtgtgtggatggtgtatatatggtatgtgcatttatgtgtgtgagtgtacacttatgcatataaattcaagtgctcatgttttactccacgtataaagagatcagaggacagccttgggtattgttcattgcctttcacctttctctttctctctcttgaatacaccacctatcattgtaggagactggcatcacagacctgccatggctggctttgtatgggatgcagggatgtgaatccaggtcctgatgtctatgtggcatagacacttaactaggaccccaacccattcacctcccaagcctgactctgctcccctgctccactctacaacatgccctctactcgataaaggcactaaaatgtgtgactaggggccatccagtttgttctgagtgtcagctcatgcctccttcttaggaagcatttcaagccaatgtctcttaataccacccacggttcattgttttctggcttctccttccttccttccttccttccttccttccttccttccttccttccttccttccttcctcccttcctcccttcctcccttcctcccttcctcccttcctcccttcctccctttctcccttccttgctttttctttctaacatcttttgtgtattgaaaatgctgatgtttttgctatttggggatgagctcttgcaggatagtgttccccaactcttctcttccaagtttattctccagatctttgcattaagttaggcaggctcctttagggacagagaccgacggcttactggaggggaaggcttcagtcccattaaaagatggttaatgaacattcaaagttagtgtttctctttgtttcagctgcagatcttttggagaatcttaggagaaagcagccaagaccactgaatccacctgacctcattaacctggagcaaactgggcttattagaatttagattgaaggcctcagaggttagatattgctcttggagaagacctaggttcagttcctagcacccacataggtcggattacaattgctgataactccagttccaggggatctgtcactttcttctgaccttccaggtcttcatgcacattgtgcacatacagacaagcacacgcacacacacacacacacacacacacacacacacacacacacacaaatattaaaactctggagtgtgaacttagtatgcccataggtaattatgtccattagctttcctcattggacattttctctgtcacctttaactcaggatgctcacaaatatccctacccctctacgtacttcctttatgaatttgtatatgccccttcccttgtttggggagcagatgtttctctactctttgatctgactgttgtgctcactggtttcatactcaccaagagacctgattcgacttaggtaccgagtcacccacgtctctcagggtcagcctgctctgtctctcagtttttggtctaagaaaacaaggccttccacccttttgatcagcagatatgagtaaaagaaataaaagttgatgctctttgttttccagggattcagataaaatgtttgccatatgcatgaaataatttttaagaggtaggttggttcttccccctaaagcaaggtttatctaagaagagtgcttttaaggatggtcgtgatgctgacagtacctcgcattcctaccgtcatttctggaaaagccattttaatttttcatctcacctcgccatctgggagacaagtgaactcaatgttttccttgccatttataaagtgagttagttaagactcgggtaagactattgatctgcaccaagatccaataccaggaaaagagatgaaattggtatccaaacttttgtttcaggactctgagccctggcctctattgtctcaaacacagttcaatcataaactgagtcaatacatctagcactgcctggcagtataaggcaattaaactatcacaaggctatgggggtaaagacactatcacaaaggtctgggataaataaacttgaacaggttgataaagtgtgggactcaatctctaaaggaggtgctgtaatctctctgtagtggaaggtttacctgaaggaacagatttgaagttattcctgaaagcatactaaaaccagaagacagtttggcagtccgaatcaaaaactttaactaaagacatgaaccacagtactttccagcatatcactcagtggctctaaagttcttttccttgtttgaaaacaatagagtccaggggaggattaaatggtgatttgtaaagtgccaggctcagggcacattcagtaaatgttaccagtgattgcagaataatggtgataatattttcctttgtaggaggaaataatgagcacgtagatttagcaacacacagatcgtttgttgtgcttttaaaagtcacagtgaaaagttggaaacaacttgatgtccagcaagagggaattgcagaagagagtttcctggtatttctaggtgctagatcattagatagccatgtaaaagaataaaaggaaataaatatgttattgcctagcaagatggccatgaatttgttgttgttgttgttattaagacagggtttctctctgtagccctggctgacctagatctatagaccaggctggcctcaaactcaaagatcgatctgcatctgcctcctgagtgctggggttaaaggcttccaccactgctgcctggctataaatgtttaaaatatattttctattaattcttcacaaattccatatatgtgtacagtgtattttgaccatattcacccctactcctcttcccaacccctttcagctcccctgctgccatatttccatcccttaccaattttgtgtactatttaattaatagatatatacatatatatatttaattctgatatatcagcacattatatattatattatattatatgttacatatattatctgttacataatatacatgtatacatgtatgtatatatatatatatatatatatatatatatatatatatatatatatacatattgatgtacacccattcattggagtctggatgccttgccagggaccactcttaagcaaagtggcctctccctgatctggaagtcccttgactgttaacagatccttagctagggctggagacttgggagccccatgcctctctaagcaggaatcctgacttggtcttgggctgccactgtgagctcatgaggcagtgttgggggagggatgctttataccatcccctttgtgactgagaattccacaaatgctcattctctgcacttggcagtgattttttacctttcaaaaacacttataaaatattaaatcctttttttttaagtttgtgcttttttgatgttgtttaacacatatattcatgtacagatacaggatagctttaaaaactaggagatgaatttgcagctctatgtcaacaaaactgacatttaaaaattgtttttattaaaattctttttatttaaactatcccagtaacaaaggcaagtatcatgtaaaataaaattgtgctgttttgttttgtttctggctttcttgtttcctactctttcctttggtttgtcagctctgtgctaccataagcagacacgatccattcaatagttgactaacagcattcttttgagtgtttactgtggccaaggccctggttctaagcacttgatgtacagataaaccagatgaacaacaatgcccttcaaaagcttaaattcaaggctggagaaatggctcagtggttaagagcactgtctgctcttccagaggacccaggtttgactcccagctcccacatggcagcttataaccatctacagctccagtcctgggaggtctgacactctggtacccacgtggtacatataaatatatgcaagcgagacatgtgcacatataattgaaatataggtatagtgatcttgggattccagtgtctgaagcaggagaaggatgagactgagatcagcctggaataagatcctcttttgattaaaacaaaagcatgtactaggtgacatgaacagcacaaccgcaagagaaggagagtagaccaaaatttctagaggagctatgccttcttaacagcattcaacccctcttctgagaatccctgcagactgccctccagcatcactgatttccatagaggctgcatagctgtcaaagttcacagtctactcagaggtaacctgctgtgtcaatatttgtaatttgtacttcatggtgagtcacttccagagaatagattatctaccatggaagggaaaaggtctgggagtgaaagtgagctggacaagacacaggtggaggcattaggtttcaacagcttcctgcctctacaaagcaaagggcaggaatgtgtgctggcgtgggctggagcccagaacagccacaactctcaagtggaggataagcagaaagcagggttagtctcctgtttctccaggtggttctagctgattcttctaggtctggaaacaaatgttaccttctatccattttctctccttctcccctggcttccatttttatagctcagaagcaaatccatcttttaagagttgttctcaagcaatctttgtctaaagctggatcctcaccatactacatcccacttcacccccacctccaccctcactgccaattgaggaagttctctgaattctgacacctccatagcatgtgatagtcccctatgttattcctatgcatcaattcatttttacattgtgctggagaactccatctctcttacaagagtagatgatcattaaggtttggtctatagaactccaaatagactggactagaaaagaaattccttctgacacataataatcagaacaacaaatgcactaaataaagacagaatattgaaagcagtaagggaaaaaggtcaagtaacatataaaggcaggcctattagaattacaccagacttctcaccagagactatgaaagccagaagatcctggacagatgttatgcagaccctaagagaacccaggccaggctactatacccagccaaactctcaattaccatagatggagaaaccaaagtattccatgataaagccaaattcacacaatatctttccacaaatcgagcccttcaaaggataataaagggaaaacaccaacacaaggacagaaactacaccctagaaaaagcaagaaaataatctttcaacaaacctaaaagaagactgcagcaagaacagaatccaaactttaacaacaaaattaacaggaagcaacaattacttttctttgatttctcttaacaccagtggactcaattgcccaatgaaaagacatagactaatagactggctacacaaacaggacccaacattttgctgcttacaggaaacccacctcagggaaaaagacagacactacctcagagtgaaaggctggaaaacaattttccaagcaaatggtctgaagaaacaagctggagtagccattctaatatcgaataaaatcgacttccaacccaaagttatcaaaaaagacaaggaggggcacttcatactcatcaaatataaaatctactaaggtaaattctcaattcttaatatctatgctccaaatataagggcagccacattcattaaagaaactttagtaaagctcaaagcacacattgcacctcacacaataatagtgggagacttcaacacctcactctcaccaatggacagatcctggaaacagaaactaaacagagacacatggacactaacagaagttataaaacaaatggatctaatagatatctacagaacatcttatcctaaaaaaaaggatataccttcttctcagcacctcatggtaccttctccaaaattgaccatataattggtcacaaaacaggcctccatagatacaaaaatattgaaattatctcatgcatcctacctgatcaccacggactaaggctgatcttcaataacagcataaataatagaaagccaacattcacgtggaaactgaacaagactctactcaatgattccttggtcatagatgaaataaagaaagaaattaaaaactttttagagtttaatgaaaatgaagccacaacatacccaaacttacgggacacaatgaaggcagtcctaagaggaaaactcatagccccaagtgcctccaaaaagaaactagagagagcatacactagcagcctgcagcacacctagaagctctagaactaaaggaagcaaattcacccaagaggagtagatggcaggaaataatcaaactcagggctgaaatcaaccaagtggaaacaaaaagaactattcaaagaatcaaccaaaccagaagctggttctttaagaaaatcaacaagatagataaacccttagccagtctaactagagggcacttgtatccagtctaactagagggacagtatcctacttaacaaaatcaaaaatgaaaaaggagacaacaacagatcctgaggaaatccaaaacatcatcagatcctaccacaaaagtctatactcaacaaaactagaaaacctggatgaaatggacatcttcctaggcagataccaggtaccaaagttaaatcaggattagattaacgatctaaacagtcccatttctcctaaagaaatagaagcagtcattaataggctcccaaccaaaaaaaaaaaaaaaaaaaaccaggaccagatgggtttagtgcagagttctatcagaccttcaaagaagatctaattccaactctcctcaaactattccacaaaatagaaacagaaggtactctaccaaattcattctatgaagccacaattactcttatacctaaaccacacaaagatccaacaaagaaagagagcttcagaccaacttcccttatgaatatccatgcaaaaatactcaataaaatccttgcaaaccgaatctaagaacatatcacaatgatcatccatcatgatcaagtaggcttcatcccagggatgcagggatggcttaatatacggaaatccatcaacataatccactatataagcaaactcaaagacaaaaaccacatgatcatcttgttagatgctgagaaagcatttggcaaaatccaacaccccttcatgataaaagtcttagaaagatcaggaatttgaggcccatacctaaacataataaaagcaatatacagcaaaccagtagccaacctcaaactaaatggggagaaactcaaagcaatcccactaaaatcagggactagacaaggctgcccactttctccgtacttattcaatatagtacttgaagtcctagccagagcaattagacaacaaaaggagatcaaggggatacaatttggaaaggaagaagtcaaaataatcactatttgcagatgatatgatagtgtatatataagtgatcttataaattccaccagagaactcctaaacctgataaacaccttcagtgcagtagctggatataaaattaactcaaacaaatcaatggcctttctctacacaaaggataaaagggctgagaaagaaattagggcaacaacacccatcacaataggcacaaataatataaaataccttggtgtgactctaactaaggaagtgaaatatctgtatgataagaacttcaagtctctgaagaaataaattgaagaagatctgagaggatggaaagatcttccatgcaggattaattggcaggattaatatagtcaaaatggctattctgccaaaagcaatctatagattcaatgcaatccccataaaaattccaacataattcttcacttagttagaaagggcaatttgcaaattcatctggaataataaaaaacataggatagtaaaatctattctcaacaataaaacaacctctggtggaatcaccatacctgaccttaagctgtactacagagcaattgtgatgaaaactgcctggtactggtacaatgacagataggtagatcaatggaatagaattgaaggcccagcaatgaatccacacagctgtggtcactggatctttgacaaaggagctaaaaccatccagtggaaaaaaggcagcattttcaacaaatggtgctggcacaattggcggttaccatgtagaagaatgggaattgatccattctttttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcggcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctctaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattttcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacagttgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagagagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatacttcttcttgtttccacttggttgatttcacccctgagtttgattatttcctgccgtctactcctcttgggtaaatttgcttcctttttttctagggcttttagatgtgttgtcaaggtgctagtatgtgctgtctctcgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtcgatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcccgtgtggacccttgcgggtgttgggcaagactctgctggcaaggtagcccggggctcgagtctcgagtcgagcagaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgagtcgagcggcgaattgatccattcttatctccttgtacaaagctcaaaagtaagtggattaaagacctccatataaaagcagagacactgaaatttatagaggagaaagtggggaaaagcctcgaagatatgggcacaggggaaaaattcctaaacagaacagcaatggcttgtgctgtaagatcaagaattggaaaatggaacctcacaaaattgcatagcttctgtaaggcaaaagacaccgtcaataagacaaaaaggccaccaactgattgggaaaggatttttaccaatcctaaatctgatatgggactaatatccaatatatacaaagagctcaagaagttagactcccgaaattcaaataatcccattaaaaacggggtacagagctaaacaaagaattctcaagtgaggaataccaaagggctgagaagcacctgaaaaaatgttcaacatccttaatcatcagggaaatgcaaatcaaaacaaccttgagattccacctcacaccagtcagaatggctaagatcaaaaattcaggtgacagtagatgctggcgaggacgtggagaaagaggaataatcctccattgctggtaggattgcaagcttgtacaaccactctggaagtcagtcttgtggtttctcagaaaattggacatagtactgctggaagatccagcaatacctctcctgggtatatacccagaagatgttccaactggtaataaggacacatgctccactattttcatagcagtgttatttataatagccagaagctggaaagaacccagatgtccctcaacagaggaatggataaagaaaatgtggtacatttattcaatggagtactactcagctatttaaaacaatgaatttatgaaattcttgggcaaatggatggatctggaggatatcatccttagtgaggtaacccaatcacaaaagatttcaccagatatgcactcagataagtggatattaacctagaaacttagaatacccaagatacaacttccaaaacacaagaaaatcaagaagaaggaagaccaatatgtggatacttagaataaggaacaaaatagccatgaaaggagttatagagatgaagtttagagttaagacaaaagggtggactatccagagactaccccatcttgggatccatcagccactaaacccagatactattgcatatgccagcaagattttgctgaagggaccctgatatagctgtctcatatgaggctctgccagtgcctggcaaatacagaagtggatactcacagtcatctattggatggaacacagggcctccaatggaggagctagagaaagtacccaaggagctgaagggatctgcaaccctatagatggaacaagaatatgaactaaccagtacccccagaggtcatatctctagctgcatatgtagcagaagatggcctagtcggccatcagtgggaagagaggcccctaggtcttgcaaactttatatgccccagtacaggggaacgccagagtcaagaagtgggagtgggtgggtaggggatcagggtcgggagagggtatagggaactttcgggatagcatttgaaatgtaaataaagaaaacatctaataaaatagcaataaagaataaccactacaaagagagaaaaggacaacaaaagcctgcagtaagtttgctagctgaacagagcagatgaataaccggcagcagactttgcaccacatcatttcctttggccatccgcacagattgccggaacaggcaaaccagatctccatgcattctgttgtccccaccctctgggccataggacttggacaaaggtaatgtcctggatctgaaagaagttaagacactgggatggtatttaattaaataataacagaggctcaactcggtgattggcctggctggaccagcctgatgtgttgataattgtctaatcctctagtggatatcaaaaaaaatcattgctttcccaagggaaggggacagccaggagaaggagaggtatacatggatgataaacgttccagatactggctaagtgcttaccagtaaattgaagtccacatttcacagcatactccaggaagtcatttctccccagccagactcaacagtctttgaaggcttctaaagtccagctgggaggtagtgttgagcctctagcatgtctattcatagactactagatcccatgagagctgccattacaattgctggagtacattttttcacttcctatcacctaaataaacttcacccactgtgtgggtttgctaatcccttcctcatccttgctgtatccaccaccctgtcttgtttccttagcaactagacactgctgagggcagggcagaaggctaaaagggagcaccagtaagtggaatgagtgagtggtggcttggtgggctgcagaggggttagttctcacgttgcctttttgagtattccccatcattttctcttctagtgcgcaagtgcagggtcctcacatctatccacactgtccacacagagagaacacatttttaaaagctagcccaaagagagaacaaagagctgaggataactattcctaacccaggatgtctgccttacattactttttaggtactttgcatttgtttgctgctactatcattgtttgtttactatattttaggagttcgaacaatcccaggcaccattcagacagaaagtggcaaatgtcatctaaaagggcagggcttaacattcccgtggcagtgtgtgcttccccagtcagagagagcactttcttgcttttactgttttctaactcgagatttcccccgcttttctggagcttttttttttttgttgtttagcttctcatcaagaaagtataagttgtaggctgcgggagtgtctgtggggatgcgtttgttttgtttttgagacagagtttggctatttagagaaggctagctttgaactcccagagacccacctgcttgtctcaagtgctggcactgaaagtatgtgtccacatacctggcctcgtgtactaattttttgataattacaaaaaagggcaagaaaaaaagaaagaaagaaaatttctttcttcagccattcattctgtagcctgttgtgtccaacactgatctaggcattcttttggggtacttgagcagaaagactagactgtgtactttctagctgggctcttcaccagcaggtgcacatttcagtatttatttggccacttgaaaatctcactgttgattttgtgataaaaaaaaaaaacaaaacccaggaacttatttgtaaaacgattattcctggtgtttatctgactcaccttatcatctgtgtttaaagattggtggggtacactctgagctatttgtacttggcaagatccccaactctgagagcaaggttttagctggctagttttcctccttcagcctctgccaagtgcttggtcctctagagaataatatgtaccttttgtccccacatattaaatacaaataaagagaagaacatgtcatcttgaggcattggaagctattaaggctatctcaggcaatctggacaactctacgccttggtcacatagtggcttcttaatatgtaccatggctcactcaagaaaaatggagtggtgaccaacttcagcctctgagttttgagatggagactctgagatagctgtcaatattttgtaaaactgcttcctaacatcccgtacccctttctgtatgtatatctgcatgcacatgcacacatatgggtatagagcccgcactggccaaaagatgagagcagatctccctggatccagaattatatatggttgtgagcttccctatattgctgctgagagccaatccagttctctggaagagcaatactcactctcaactgctcagtcgcctctacaaaccaactgttttttgtttgtttgtttgtttgtttgtttgtctgtttggtttggtttggtttctcttagacagggtctctgactgggaccgaggcttgctgagtagggtaggctatttgaccagcagccctcaggaatgcaagtattttcctcaacatctgatttcctctttcctttctccctccctccctccctccctccctccctccctccctccctcccttccttaatttcttcctttcttctttctttcttcctccttccccctctcttcccctctctctctttctttttttccattgccgacatgaagaagtagagatgagcatgaccaaggtcagtttctgcttttcctgtgacaagggttctccccagtcaaccctggtctgcccacagaattcttatcccactgaaaggaatagacatttccctacatgaagagttgtaaagtggtggttggtcccattgcatgcacagagagtgagagacgggtaacctgtgagacacctcctacataaaaagagttccagtgatcttcaaagtgtttgtcactcacccagaaaaactccagctcctcactaccaagcctaggaaaggaagacagaaatacctagagaggaattccaatcacctcaagaaaaatggagtagtgaccagcttcagcctctgagttttgagatggagactctgagagagctgtcaatattttgtaaaaccgtttcccactcgatagcattcccagagtgaaggtttttctctcctcagccatgagctaggcttctggatttctacatcctgtttcatttgtgttcttcctcctatatttaagtgtaagcttgaatgagcgtctcagttcacttcccacaatacgagaatttcccaaacaaggagggcacaccaaactcatgttagcagtgcctcttcaggtgttgcccatttttctccttcaaaagtccccaagcctcccaggtactactttgccagttcaggttgttcaggggaggtacaccaagtgctgattcccactgagctcctactgaccctattcagtattgtgccacagtttacccttctcttctcttctcttctcttctcttctcttctcttctcttctcttctcttctcttctcttctcttctcttctcttctcttctctcctctcctctcctctcctctcctctcctctcctctcctctcctctcctctcctctcctctcctctcctctcctctcctctcctttcccctcccctcccctccccctcccctcccctcccctccccctcccctcccctcccctcccctcccctcccctcccctcccctcccctcccctcccctccttttcttttcttttcttttcttttcttttcttttcttttcttttcttttcttttcttttcttttcttttcttttctttgtgataggcttgggaagcttcccctgcaggactgtggagctcttgtgttcacatttgtgccttttggaaagatgcttcagcggctggacccgaggcaagagtttgtcttcaaaatgctgccattgcctctgtcagttttcatctgcctgtaaactttttttttttctttttgccaaatctcctgaagcaacttgacctcaaggttttttttttttaattccctcaactctttctttattctttgttccattttcactatcttttttttcttattagttaagagaaaccaaagaattgattcacctgctcattagttttctcgaatattcccctgtgactaaagtaaaactaggctacacccctaagagaaagatgcctcttagggctcctgtcatcttcctattgtcttgactggtgtgcatacaaagtttgaactatgaaactagggcatggctgattttggctccagtgtttacttgtgaaccagtctattcactattgacctagctttcagattccacagcccttctagcttccctaacataaaaacataagcattatatgtatttaggaagtatcatgttgtgttccaataatatttatgcagtttgacctcagttgtgcccttaatccttgtagtacctgttttagttagggttttactgctgtgaacaggcaccatgaccaagtcaactcataaaaacaacatttagtttgagctggcttataaattcagaggttcccaccaatgtcatcaaggtgggaacacgatagtgttcaggccgatatggtgcaagaggagctgagagttgtacattatcataggaaggctgctagcagaatagtgacttccgggcagctaggatgaagatcttaaagcccacacccacaagagcacacctactccaacaggaccacaccttctaatagtgccactccctgggccaagcatattcaaagcatcacagtatcttaattagaaaagtgggagctatcccttgttcatctgtcttagttgtcttgactgctataacaaaacacctcaaactcattcattcacaaag

SEQ ID NO: 6 - DNA, 123 bp, Mus musculus
atggggacccgggcaagcagcatcaccgccctcgcctcttgcagccgcaccgccggccaagtcggagccacgatggtcgccggctctcttctcctgcttggattcctcagcaccatcacagct

SEQ ID NO: 7 - DNA, 96 bp, Mus musculus
tggtacattctggtgccaagtgtggccattcccctggctatcgccttcctcttcttcttcatctgtgtgtgccgcaataaccagaagtcttcatca

SEQ ID NO: 8 - DNA, 3075 bp, Escherichia coli
ggtaccgatttaaatgatccagtggtcctgcagaggagagattgggagaatcccggtgtgacacagctgaacagactagccgcccaccctccctttgcttcttggagaaacagtgaggaagctaggacagacagaccaagccagcaactcagatctttgaacggggagtggagatttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataa

SEQ ID NO: 9 - DNA, 249 bp, Artificial
  Synthetic
gtaatgatcataatcagccatatcacatctgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcccc

SEQ ID NO: 10 - DNA, 34 bp, Bacteriophage P1
ataacttcgtataatgtatgctatacgaagttat

SEQ ID NO: 11 - DNA, 1213 bp, Homo sapiens
ggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacg

SEQ ID NO: 12 - DNA, 804 bp, Escherichia coli
atgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctga

SEQ ID NO: 13 - DNA, 477 bp, Artificial
  Synthetic
gctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcc

SEQ ID NO: 14 - DNA, 3626 bp, Mus musculus
  CDS (443)..(2407)
  sig_peptide (443)..(565)
  mat_peptide (566)..(2407)
gtgtccccgagctgagtggccatccgactcagtccctcgccggccggtctaggcagcggaggaggcgagtgcttgatagtggctggaagcttcgctatgggaagtcgctctttagcactgtcgcggctagccctgctctctggttctccgcagccgctgtcgttggagagcaccgggaggcgcgggttgcgagcgcgcctgcttctcaccgcccgggcgccagcgcccctgggcaggtgctgagcgcctttcggagcctcccctgctgcctccctcttccgcctgggtgcctggctgctgcagtgcacatgggctgctggaggtagatgggctcaccgcccgtgaggcggcggtggatgcggcgctgggcagaaacagccaccaattccagctgccgtggggccgagcgccccgggcgccgctgcgagccccgagctcggccatggggacccgggcaagcagcatcaccgccctcgcctcttgcagccgcaccgccggccaagtcggagccacgatggtcgccggctctcttctcctgcttggattcctcagcaccatcacagctcaaccagaacaaaagactctgagtctccctggcacctaccgccatgttgaccgtaccactggccaggtgctaacctgcgacaagtgcccagcaggaacgtacgtctccgagcactgtaccaacatgagcctgcgagtctgcagcagctgccccgcggggacctttaccaggcacgagaacggcatagagagatgccatgactgtagtcagccatgtccatggccgatgattgagagattaccttgtgctgccttgactgaccgagagtgcatctgcccacctggaatgtatcagtctaatggtacctgcgctccccatacagtgtgccccgtgggctggggtgtgcggaagaaagggacagagaatgaagatgtgcgctgtaagcagtgcgctcggggtaccttctctgacgtgccttccagtgtgatgaagtgtaaagctcacacggactgtctgggtcagaacctggaggtggtcaagccagggaccaaggagacagacaacgtctgtggcatgcgcctgttcttctccagcacaaacccaccttcctctggcacagttaccttttctcaccctgagcatatggaatcccacgatgtcccttcctccacctatgagccccaaggcatgaactcaacagattccaactctactgcctctgttagaactaaggtaccaagtggcatcgaggaagggacagtgcctgacaatacgagctcaaccagtgggaaggaaggcactaataggaccctgccaaacccaccacaagttacccaccagcaagccccccaccacagacacattctgaagctgctgccatcgtccatggaggccacgggtgagaagtccagcacagccatcaaggcccccaagaggggtcaccccagacagaacgctcacaagcatttcgacatcaacgagcacttgccttggatgatcgtcctcttccttctgctggtcctggtgctgatagtggtgtgcagtatccgaaagagctccaggactctcaaaaaggggccccggcaggatcccagcgccatagtggaaaaggcggggctgaagaagtccctgactcccacccagaaccgggagaaatggatctactaccgcaacggccatggtattgacatcttgaagcttgtagcagcccaggtgggaagccagtggaaggacatctatcagtttctttgcaacgccagcgagagggaggtggcggccttctccaatggatacactgcagatcatgaacgggcctacgcggctctgcagcactggaccatccgtggccctgaggccagccttgcccagctcattagcgccttgcgccagcaccgacgcaatgatgttgtggagaagattcgtgggctgatggaagacaccacgcagttggaaacagacaaactggctctccccatgagccccagtccgcttagcccgagccccatgcccagtcctaacgtgaaacttgagaattccactctcctgacagtggagccctcaccgctggacaagaacaagtgcttcttcgtggacgagtcagagccccttctgcgatgcgactccacatccagtggctcttcagcactgagcagaaacggctcctttattaccaaagaaaagaaggacacagtgttgcggcaggtccgcctggacccctgtgacttgcagcccatctttgatgacatgctgcatatcctgaaccccgaggagctgcgggtgattgaagagattccccaggctgaggacaaactggaccgcctcttcgagatcattggggtcaagagccaagaagccagccagaccctcttggactctgtgtacagtcatcttcctgacctattgtagaacacaggggcactgcattctgggaatcaacctactggcggggtgatttcatttcgtttctgacttttgtgttttggtgtgtatgtatgtgtttaacagagtgtatggccggtgagtttgggttctttctttctttctttctttctttctttctttctttctttctttctttctttctttctttctttcttccttcctgaaagtgaatgtataaagcctttacaatgtataactgttggaaaatgcccaccactaaatttttttttaagttccacatattctccatttttgccttcttatatatatcttcaacactattctgtgcactttaaaaacttaacataaacgcagtgtgacttctcccatatgctgggtcccgagactctcaacttcttaaaaacctaatggcatcttgtgactcctagaagtagacataagtctttcaaccttcacacctactctttctgttttaattattattgctatttgtcttattgtttgtgctttacaagcgttcttgaggacggagggaatctacgaccctgttgatgactgtaactctattcgactttgagttgtcttcttcatgtcttgttatatagttcatattcatggctgaaacttgaccatactccctagcgctgattgtatggttttcgtctggacaccgtacactgcctgataacttgtgcacctcttaacgctactatgctctgggctggagaatgaaatctttaagtcaccaggacttgctgtttcagtggcttgacacctgggccaccaaagaactcgatcttcatcttttagggacacctctgctgcaccttggaaagccaaccttaagtgccagtggcactttatgcccagctttgctttgaaagatatctttcttgttttttttatccttctctttctctcttttttttaaaaatacacatagtcaataggtccagtctgccctcaaggccttgctgggttttcttcatcatccaatcactttcattaaaaatggctgcagctgtaagaactcttgtctgataaattttcaactatgctctcatttatctacctgccctctgatgctcagtcgtcagactctaatgcaaaggtggacgtcggctgcctttgcgtgggcgggcttagtggtgaggaactgatatcagaaaaaaaatgccttcaagtatactaatttattaataaatattaggtgtttgtt

SEQ ID NO: 15 - protein, 655 aa, Mus musculus
MGTRASSITALASCSRTAGQVGATMVAGSLLLLGFLSTITAQPEQKTLSLPGTYRHVDRTTGQVLTCDKCPAGTYVSEHCTNMSLRVCSSCPAGTFTRHENGIERCHDCSQPCPWPMIERLPCAALTDRECICPPGMYQSNGTCAPHTVCPVGWGVRKKGTENEDVRCKQCARGTFSDVPSSVMKCKAHTDCLGQNLEVVKPGTKETDNVCGMRLFFSSTNPPSSGTVTFSHPEHMESHDVPSSTYEPQGMNSTDSNSTASVRTKVPSGIEEGTVPDNTSSTSGKEGTNRTLPNPPQVTHQQAPHHRHILKLLPSSMEATGEKSSTAIKAPKRGHPRQNAHKHFDINEHLPWMIVLFLLLVLVLIVVCSIRKSSRTLKKGPRQDPSAIVEKAGLKKSLTPTQNREKWIYYRNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPMPSPNVKLENSTLLTVEPSPLDKNKCFFVDESEPLLRCDSTSSGSSALSRNGSFITKEKKDTVLRQVRLDPCDLQPIFDDMLHILNPEELRVIEEIPQAEDKLDRLFEIIGVKSQEASQTLLDSVYSHLPDLL

SEQ ID NO: 16 - DNA, 168823 bp, Artificial
  Synthetic
ggtgttccttggcaactcactttttctttttaaaaattgtgtgtgtgtgctgtgtgtgtatgtgtgagtgggtaagtaggtgtacagcagccaggggaggatctcagatgtcttcccctatcattctgccttgtgccttgtgcctttgaggcagaacatcttggtgaacccagagcttatatatgtagacacacacacagatatataaacacattatatgtatataaatatatataatgtgataccataatatagatatatacacaagacacacacacatatatatgtaatataatatatgtaatttatatacacatatgtatatgaatatatatatataatatgctaccataatatagacatatactagacacacatatatgtaatatatacaaatatgtatataaatatataatttatgctatcataatatatataccctagacatatatgtataatataacacatatatgtgatatatgtgtgtgtgtgtatatacatatatatatatatatcacgcacacacacatacatacgtctagggtagcaaccaatcctagtaatcctcctgttttcattcccctcaatggtctacaggcatgtatgagaccacatatggcttttatgggtgtatgtgtgatctaaactcagaccttcacgtttgcataataatcactgttaactgctgagccatctctccttctctcactttcctttctttttgaaaaaaaattttttatacattatgtttttattttattttacttatttttatttttttaatattagatttttttctttatttacatttcaaatgttatcccctttcctggtttcccctccaaaaacccctatcccatccccactccccctgttcaccaacccacccactcgcttccctgtcctggcatgcccctacactggggcatatacattaggttttgagcgaattccaggatagccagggctacacagagaaaccttgtcttgaattaaaaaaaattttttttttaaattagagttgctgccatgagtatgagcaacttaagaaaattatctctcgccgggcagtggtggcacacgcctttaatcccaacacttgggaggcagaggcaggtggatttctgagttcaaggtcagcctggtctacagagtgagttccaggacagccagagctacacagagaaaccctataaaaaaataacacacacacaaaaaaaatcaaaaacaaaaacaaacaagagagagagagagagagagagagattctttccctccaacttctcccagaccttccctacctccattcccaccaacttcatgtttttttttctctctctctctttctcaaaaccaaaaaatgccaggaaagcaacaaaaaataagtagcaagaaagtcagaacaaagaaattaaatacgtaagtaagtaaataaaaatagaaaatcagcaatattaaaaaaaaatcaaggactggagagatggctcagcagttaagagcactgattgctcttccagaggtcctgagttcaaatctcagcaaccacatagtggctcacaaacatctgtaatgggatccgatgccctcttctggtgtgtctgaagagagctacagtgtacttacgtttaataaataaatctttaaaacaagacaacacaaaaatccaaaataaaatttcaaagtgtaccaacacaaaacatgtagtctgttttgtgttggtcaactactcctgggtatttaggcttccttggagtgtggttgctatacccagtgacactcagttaagaaaagtgaatttccctttcctggcagggatcaattgcaagtagctttttggttaggggtagaatattatattccaccttcctgtgctggttccacctgtaaatgtctgtgcagagctgtttatgtttacgtctcaggcagagctctgaggaagatattagtaagcaagacattccttggagagtgcttgggggatccagcaactgtgaaaggaaaaagaaatattaatcaaagggataaattaaccttcaatacagtttcagcaaaggcctctcatggtgctgtccccagttgaggcaaggcaacagacctttttcctcaccaaacactcactggtgtaggggcatggtatgacctgtcatcaggcagggaacattcaccacacagagtggagaggagctgtggccatctcttcaatcagagcagggtgttggatggacgttgccagcctgtaccacccaccattcacatcagctgctctgtgcacacagcacactccaacccacagagaaggtttgtttctgtttttatttttgctttttattattatctcatgtaaaattattatttattttatttttgctttttttattattatctcatgtaacccaggttggctttaaatttgttatgtagtcaaggaggactttgaacttcttccctcacctctagagtgctggggtcacaggcacgtatcactattcctgttcacctggtacttggaatcaaacccaggcttcatgaataatagacctaaactcttccaaaccaagaagaaccacatctcacgagatttgacatgctgtgggtttttttttttcctctcccccctctgtctctctcctcttctgtccctctttctccctcttctttatttctttcatttttatttttacttttgaaaagaagctggcttcaaaattctccatatggctgaggacgacttcagcctttaatttctttttttgtttgtttgtttgtttttctaggcagggtctcactacacagccctggctgtccttgaactcactatgcagactaggctggcctcgaacctggagatctgcttgcctctgcctcctcagtgctgaaattgaagacttgcaccaccaaggtatttttagttaatcgtttgaaaaatttatacatgtttacaatgtattttgatcaaatccaacagaaatcttcctctcacttcttctcagtccccctacatctttcctaccataatttctctctttctcttctttttatttttgaaataacccaccaagtccagatagtactgtctacaagtgcataaatgtagagccatcggctaaagcatggccaggctactagtaatcccactgaacattacacacgttctttggtcaaattaagcaagcttaattttctgttagacagggatagctccctaaatcagactttgataatatagcatgacacttaagagaaagtggggcttgtagagcctccaaaacctgcaagcctgggggttttttaaggcttgggagacttccagaggaattttgattgcataggaacttggctagcagaacatcttatcttatcagggtgcattcaaggtgtgagtcaggctccagagggtggggagcaagtcggattccagaaacacacagtgagtgtttggtgaggaaaaagcacagtcaacctgaattttgcagcagacagaaatgaacttctgaccttataacaaaatggcttccgtccttaagatggcgtcaggctggtccatcagtaactacacccctgaagaaaagttatttcctctccctaactgtcaccaattgccagcaacttctcagctaggaatagagcctcatgatttcctctcccactcatactgggtgttgactggcttgagtgccatgccacgtcctgaagacagcatttcacagcatttgtccctatcctctggctcctacggttcttttgttccctctgctgagatgtaggtaccccgagccttgtagtagaagtgacaggcatgtcccatttatggatgactactcaatggtcacatactctcagaactgtggccagttatgagtctgtgttgactgctgcctactgcaaaaggagtcttctctgggcaaaacagtagtaatctacatgtataaaacacaaatgcttacaaggtagtttgatgggggggggggactgtcaaacaacccttgcacaggggtcacctaataccatctgcacaggggatatttgtgccttccctcagccttgagtaggctaaacaaacccatgatagttttacaacctagctggagtcttctgacctcaccacatttgcaatttcctatagagctttgaggagtagactgcccactgagcttgctttgcaacataatctggctgaaacgaaggatggggtttgtgggctttctcagtgctgaaaattaactttgagccttgatcagaaacgtttgtctttgcttcatccttctcttgcacccagtttttttctcagttccaggcccccccccgccccgcccctttcaggtatacccagtttgtccatggccactggacagctacagatatttacattacgattcacaacagtagcaaaattagttatggagtagcattgaaatagttttatggttgggcatcaccataacacgaggaactgtcttaaagggtcacagctttaggaaggctgagaaccactgtcctgcagcctagctctcatgggtccttgataaggtttgtagcaccagacatgaactttttcctgtggagcagccctcaaagacagtcagaaagagcagttggttatcccaacaaccaacatgtcactattatatcaagggggctttcctatagcgtgaatggtcctcagagggtaagtccatcttttctccccacgtcgcagggatagcatttcctggcaccatgaaagcaggccagtagaaaggaagtttctaaggaccttgtacttctgatcctcctcctcgcatgtgttgggattacaggcctgcaccaccacatccagtttattaggggctaggcatgtgcacagtaagccaacactcaataagcagaacgacactcagacctcagccccttcatttagtgttagtgtgttggtggttgtttattattattattattattattaattcaccacacagcaatttatgtcctacatgtcacattcatttttaaattccctttactttttcccctactttgttttagaatatatgtatatgtgtatgtgtatacacgcacacacacacatacatatatatgtgtatacacacatacatatatgtgtattcatgcatatacatatgtgaatatacacacatacacacgtatatatgagtatacacacatatacatatataatatgtgcgcacacatatattttatatattagcattccagcttaggggcttcagtgtagctcattggcacagctcttgtctagcgttccagttttatttctacttttggcttttaagtctatttgttctattgatttaaagcttacagtacctcggtgggggcacacacctttaatcctagcactctggaggcaaaggcaggtggatctccgagtttgaggccatcctggtctacagatcgagttccaggataaaccgaaagtagagaaaccatgtctcagaaaccaaaagctaaaacaaacagaaaagattcacaacaaatatttttaaatcattacaatatattacaatatcattaatattacacccctttaagggtagtataagaatctttatgttatgtgtctataaaatgggttgaggagctggtgagatggttcagtggatgaaggagcttgttagcaagcctgccaacttgagttcaatccctaggacccacgtgataaaaggagggagtagattctttgaagttgtcctctgacctccacatgtatactatgtcacatgtgttcggcataaaataaacaaaaacatagaagggagcctaggagacagtgccgttggtacaaagcctgctgcaagagcatgaagccctgagtttgagccctagcactcggtcttatgcatacagcacatgtctgtaatctcagcactggggagacaaaagagtgagtggccctggagtttgctgggctgccagtcaagccaaatcgactagctccagatagggagtggggcagagaaagactgagcccatctcaatggtgggcaatgattgataaagacatccagtcttgccttctggcttcccataagtgcatccctcagtgatatactgttacctggaagagtaagccaaccaagccctttcctccctaactgattttggttggaaaggaggccatttccatgaagctaggaattgaccttggatggaagatgctggcggaagtttctggtttagtccaggtggcccccgaagtgtgggctacaccatttcccagaaacctctagtaggcatgcactccagctacccatgctggacactcgttctttgatctctctcgtttactttcttattttccttatattatttgctcgtttatccccagacattcctgggactgtcttttacacaaattcttcacatcccatgatgtctttccggctctccgtcttggaagaaaacacccaagtgactgactgtgaccaaacggttacatgcaaatgtatgaaatctggggacgaatgcagtaataaaaggtgacttaaaggggctggagtgatggttcagtggataagagcactgactgcacttccagaggtcctgagttcaattcccagcaaccacatggttcacaaccatctataatgggacccgatgccctcttgtggtgtttctgaggatagcaacagtgtactcatataaataaatcaatcttaaaagaaaataaaaaacatttcattaaactcgataataggtataaatgcgaacttaatggatgttctcagggaagttgactgtaacttgtaatttgttcagtgaatagcaagcatataacaaccagacggctaaaactaccacaccgctaccacacatgtttctttacgtatcacatctgcatttccccttgcctcaagcatagtacttggaactttgttcctcatattttatgactgccttcatttttttagaaaagagttgttactattattatatgtaagtacactgtagctgtctttagacacaccagaagagggcatcatgtggttgctgggatttgaactcaggatctccagaagagcagtcagtgctcttaactgctgagccatttttctagctcaagtgcctttgttctttttctggagtttctggatctagacagtgtgccttaattttgttcttcagtgatgtttccagcctgcaaccgagcttcccttcctcggctggaaacccatctttgccttctagattcctgaagaggttgaatttcatgtgctgactacaggtcccttcttcaaaacccattctgccctcagaatctatgaacccgatttaaaaaaaaaaaggatttttatttttatgggtttggctattttgcctgtattcatatctgtgcaccacatgcatgaagtgcttgcagaggccaaaagagggcgccagatatcccggaactggagttacagatggttgtgggccagtgctctggaaaaacagtcagtgcttttaacccctaagctatctcaccagccctcatcttctcttagaccgagtgctagggctcaaactcagggcttcatgctcttgcagcaggctttgtaccaacggcactgtctcctaggctcccttctatgtttttgtttattttatgccgaacacatgtgacatagtatacatgtggaggtcagaggtcaacttcaaagaatctactccctccttttatcacgtgggtcctagggattgagaagtcatctgtgatttttgacccagctgccctacctcattttgcagggaacagggatggggatgggaatggcaaagggcaggacactgttccaccttccgcctcaaggctgttaacaaggtggtttaatactgaattgccagcccagcccagcccagcctttcactattttcccggtattgtcaaacatttcctccacactacctatagaatattcttacttatgtttaatgatctactttagtgtttattttaagtacatactatgttccgttccttgacctcgctgtactttgtttattcgtaaatatacttacccacctgttgtaataaaaatgtccttctgtccttccttcctttcttcctttcttcctttcttccttccttccttccttccttccttccttccttccttccttccttccttcttttctcccttccttctttcctcccctccttccttctttcctcccttctttctttcctcccttccctccctcatttctttaacgttcaaccaatgtttctttctcacgtttcctttccaaggtcagttccgagggctggacaaccacactaagctcagcggctccgcacatcctgccctcgtggagcccatgttaaagagaggttggtggagacacgcaatggacactggagacaacgacttagcttagtaccctaaaagtgaatggaggatatgcaaaaataagatagaggggagagcaaaggaatttggcgtccagcgttagtgtgtgtgtaggagtgcgtagtaaagagcagaagctcgttacgtgtgcagcggatgtgagagtctcacagagggaacccccagcgctaagttcctgaggcttggtgggtcaaagaacaaattaacctcagcatagttacccttccataagcaacaaattctccaggtccactaagcctcgtgatcagcagcctgtacagtcacttatgaggaacttttatagggagaacaggatgtgatggtgtatttaaacatatgtatttaaagatggctcagtgaataagggtgcttgttgcccagacctgagttcaatccttgggctccacgtgggggaaggagagaaccaactcctgatcctccacatgaatgctgacatgagcatgcacataagcaatacatgagtctaattttaaaaaaggaaaaatacctctggttaacatataataaattgctattcttttagatggttggattcctaatacacaccagcacagagtgaacgcactgggtaatgtacaatagcaaggtgacttacatcaaactacattaaatgtttaaaacagtgaaaacctgaaaagctaacatttttgtccaatgtgaaaaaaaagtcttatttagtagcatgatatacacagaggtaaaaatagatatcagaaagtcccccacatatgctaatcaattttgttcttaatctttacatatccacttatttttgtgatatctttattttatgcataagggtgttttgcctgaatgtatgcctttgtaaatacttgcatgcagtacccacaaaggccagaagagggcgtgagatcccctggaattgaagctactgatggttgtgaaccaccacgttggtgttggaaatctgacccaaatgctctgcaagagtcgccagtgctctgaaccatgtccaagttatctctccagcattatatatccacgtttgaagtagaggtacattgggcttttcatttttatagtggttacttaaagcatagtctatgctgtttttaagtgacagaatgttgttcattgtatttaaaaaatatagacaaaaatttaaacactttaaaaaatattatttttctttatgaagatacatgcttttaaggggttctgttggagaatttcagtagcgccaacttaaaacaaatactttattagggctgtagaaatgacttagaggttaatagtgtgcactgctcttgcagaggatccgagtttggtccctagcacccatgtcaggggcttacaacacaacctcctgtaactgatgctgcaggggatcccaccccctcttctggcccctctcatgcacaacacacatgaggcaggcacagactgatgcacatatatgtgaattaaaccccaaataaaatcgttttcaaaagtccaatgaatgtcttgacaatgcttttataatcaattcattcatgacaggtggttccctgtgtttgtgatttctcttcaagctgcgcatcaaagcaacccctccttctccctccttccctccctcctcctcctcctcttcctcgttctcctccctctctctgtgcatgtgtgcctgcttacctgtttgcgcaccgcaggcgtgcaggtgcccacggagtgattaatgaattctttggaactgggttacaggcagttgtgggcgatgtagtgtaaatgctgggaaccaaactcgggtcccttggaagagcagcagtgctcttcacagatgagccatccctcaagtccccaagaacttgtttctcttgctcagcttgcactctccaagacttaggaaagtgcttagtgaataagctggggcacaaaagatgcggttataagaaggtgacgtaggagcctctggcaagcgatgcagatgccaattctcacttgtgttccggtccctctcgcttttgtcagttttagaatgttctaggctgggtttggtgctgtcgtagcacagagaggaaacagcatgaaggacaaccaggccagagatagttgatggtctgagccttttgtttgctggcttcactcgctccgctgttctaaagcttcagtcaatgggtctatgttgaaccagtttccgctgttcactacaaagatgcaattggaagccgagggagggagggagaagctctggagagtatggctcagtggttaagagcactgactgctcttccaaaggtcctgagttcaaatcccagcagccacatggtggctcacaaccatctgtcatgggatctgactccctctgaagacagctacagtgtacttagatataataataaataaatcttagaaaacaagtagctgagggaggagttttttacttgtctcatccagggtgcctggaggatgacggcgaggcgccactttgcttacctcaccaagtgagagggacaaaacatagttttgatctgcagtagcttcgcggtgagcaccacatctccacctagtcctccgctattgtcggctgctatgaacagaccctgctgtcacctggccatttatctccatggtcctgtttaagctctagcctattgactaaggggatgcaagttgaagtggatgtccccacgtttgaacacagcactacatgctggtatctgaaatctgagtcacatctaggtcagtcacattttctagatttatgagtctagattttatttttccaggtgtcttgtttttctgtctctaaatgatgacatccacccccctgccttcccccccccccccacacaccatataccctgggtatggttatttgtagcaaaatcaatactcttgtacttgaataatttttttctttgcattttgaaccaaggtgtttattcacaaaaggaagaattgtccatttgtctgtctgctcagtctttggcttagcatagggcatgtgcagaggctcaataaaaatcttttgcctcaatcagtacatggcacatgcattacctcagggtcatatttgtaaataggtatgggtgtttgcctacaggtgtctgtgcaccacttgcatgcaggtgcctgaggaggccagtagagggcatcagatctctgggaactggagttacagatggctgtgagtcaccatatgggtattgagtacaagagagactctggaagagcagacagtgctcttagccactgagtcatcactgtagcccgcatgccatattattaaggaggctgaacaccaagtgattcagcctcgctacagacaagtagaaacctgtctctggcctccttaaccacaaagttggggggcttccctcgacacagaagccagagaaccatttgacaccgttcctctgtcacaggctgtatcattggtccattttccacatgacactgtgcattcaagcattcatctctgcagatccctgggcagtatggcagtgtgtgtgtgtgtgtgtgtttgtgtgtgtgtgtgtgcttgtgtgtgtgtgtgtgtgtgtgtgtgtgtgtgtgtgtgtgtttgtgtttgtgtgtgtgttctaattggaaaggaaatcttcacttgcctttaaagtgcagtgctactatatttctttgcaaatatatatacgtatatgcatatgtatatgcagatgtatacacacacacacacacacacacacacacacacacatatctcaaagttcctttcaggctgaagaatccattattgtcgggccagtgagatgacagagcagtttaaggtatctgctgccaagtctgatgacctgagctcaatccctgaaatccacaccgtggaaggggaaaactgtctcccacgagttgttttcttgaccgccacaggtgtatgcaaatatgcatgtgcacgtgcacacaagcactaaataaacagaaagtttaaaaaattaaggtatatattatttactatgtaagagaacatcaaaaaagtcttgagaagtacaccatgggagaaaacacacctagcccttcaaataatttgcccttctagaaaaatcctgaaatagccctttccccatacagtagtagaatgataacattatctcagagatgagcaggcgtttaaggctcagcggaacgggaagagagttgggtttttcttcctatttgttttgaatagctctgctcccgggtcctctgcttgcccagatgatctgtgaaatgggtgagtgagcagcgcacctccccagcgcgactgttactgacgtcagcaagcctcattagctgctgtttgtctaaccaaagggaacagcgggtggagagaatcttaatgacctgacttcccacactgcaggtgccacttgcctggtgtgcacgctgagattgcatcagctgactaggcaaacaaggaacagtggaaatgggaggcagagaaaaagcccaagagagactgcccagtgagtggaactcgctgctccatcctgggagagtgtagcagagatgtttgtgcgtggtggagtgaggtcgactcaggttcacagctgtgcgctgctacatagtagttgagggtcgaatcacttaaaggctttagtcccgttttcaaaattaaaatagggataatgatagaaccttagggagaaggagggacacgtgtgtaaatcacagacctcattgtaccactggataactggcaggagccactgtttctgactctacagtggagagaagggaagagcaatgattggcactgtggacgcaggtggcagagaacagctaaagatgactttatatcctaaaggcaagtggggtagctgtgagttttaaagaccgaaccttgcttcacaaaattgctcttgctttcctacctaccaattctgcgttctttctttttccctggcagcatctccccggcggactcagccttggctacagcggagactcctgggaaggaaatgtccttccccagccctaggcacagtggttattgtctgttctcacatcctgtgagccctgtaggcagaggaatgccccagaaccacagcaactgtgcaaacatttgaattcccacgggtagtttcccatcctcgtacccatgaggcttctgctctctgtagtcagaagaacgtacacagttctcaggagcaggaagtagagggctaggaatcatgggtgaggagcctagcatgtgtgtgaatacatccgtggaaaacgtttttgagggagatagtacagaatcctactccaggtgaaataatgagactcttgctaagaccacgtacggatgacccaatcaatacacaaggagggagttgaaaaggagaaaaggggttggccattaatttagccaacgtataattccacgtattagcaagtaactttaattatcctatgcgccctcggttttattctccacagctgtaaatggtaataataccccctttgaacatttatcatgattaattaaggcagtgttgttgaaacatattgaaagttacctaggctaactttgtccaatttgccagctgctttggcaaatcctctgcactggggctggctcaggctagaactatcttccatctgggtaaatctcttctccattccagagcagatatcatggcgggtagcttgacctcacagtcatgagacaactcaaaccatggggattggcaaatgaagcaagtccttgttattgaactctccactcagaaaaaataaaaaataaaaacatattaatactacggaggattccagtgacactcccttctgggaaagacactcaagagatttttatgagcagtcagggcagatggaagtcacaaggcaaacacctcaaagtaaaaaaaaaaaaaaaaaagatcaacataccagagcactcaacaagctgacagtctggctgcccatgctagatgcttagaatacatgaatgacaaagtttgtatgcagtctctgcctttagggactttactgctaatgggggattgtttatcaaacctaaataatatccttgagggaatattactatactgtgggtattagtgttcttaaccaatatgggtgttgactttgtctgtgtctctctctgtgtgtgtacaacgtttgggagtcaattctgtctttccaccacatgggtcctggctatcaaactcagtctctcagcattactggaagatgcctttgccccatgagtcatcttgacagcaaaattgggtattgagaacttgaaagtttgctgtgtgaagaataagtaaaacatgctaaaaaaaaaataaagtagacaggctgcacagatggctcagcagttaagagcactggctgttcttccagaggacccaggttcatttcccagcacctacatggcagctcacaactgtctgcaacttctgttccaggggatccaactccttcacacatgcaggcaaaaacaccaatgtacatacaataaaaataaataagttatataaaaataggcaatctcatagttttaccatgttaattatatgttaaactagcaatgtgcatatattgcattaaataaaaatgattccttaactaaattaatttctttaattaaataaaatgcaaaaaaatgaatgaaataaaatcactttcacaaggtggagaaacactttgggaagacatccagatgtgaacctcaggcctccacatacacaaacattaataagtatgttaattaaaattaatttcactttacttttaaaaatagaactactagattgtttaggatagaatatataacttctgcccaatatttgctcatattcttttggaaaatatgtgttcaaatcctttgcttattcttaaattagattgcttgcttttattgttgtatttttttctatcccaaatagccaaatagtatatttgtttggaggtgtatgtggctgttttaagacaggatttctttttctttttcttttttttttttttagctctggttatcctggaactcactctatagggcagattggcctcaaattcacagagatctgcttgcttctgcctcctgcatgctagggttaaaggattgcactggtgctgggcatgacaacccccccccccctttttttttaaccttcactggtatagtacaaatatggcacacagaccattcacccatacacataagagaaggactaaacaaatatgtttaaacattaaaaaaaaaaaaactattggaaacggaatcgtcaaactggaatggtggagatttcatcagaactggctttgttcattttcctgtctccgtcaaactgtctgctctgtcacagtctggttctccaccacgtggctgctgcttctgttggttcagatccctgctccgcagtctgagccaatgaaatcccggctcttcacaaaggcggttttagtggcaagtctttggggcttcttctgttctcttggaagaatggccccagcagcttcttccatagcgcttctggtgaaccagatggcatcttgttcaacctcttactgcactgagcacgcagcctccccttacaagattcataccaatgtctcattgttttccaaagtaacttgagacttgaactttcccagactctcaaataaaaccattccttgtggaagagtgcggtggtctccagtctttagagactgcctgcctacctaagctttaggggacagagtgggacaacactaacaaggtgtgtgggcatgacaacctctaatcttctcagctagcttcacctggaatctcagtcttatgagtaatctggactaacagtaagggactcattatttgatgcttgccacatctggggtcaaatcttggcccctagaaatgggagatggatggacaaagatgtcctatacctttagctataccttctaagaattcagcctcaacagcttggagacagacgggaggacaaacagggtgggcttccctggttgctgggcccgcttagggcttggctgtaggctgaaagggaagggagcttgctctctcggccacacactgtacttgcatctccatcgctgggatgcagacagtgaagagaacagaccgtagctctgcttgttctgagacataggaaagcgctccaacaaatgtttcttcacctatcgtatgctctgaggacaatttccacagactctagatgatcatcgttgcacaatttttaggaatcttcgcagtttccttgaagtgtgtcctcaagagttcctgatgctgccgttatagaagtgggagtagttgggggttttatagacaaactctaaaactaaaagaaggagatatacacagttacagaagtgtttggtcagcaaggagtcaaaaaattagccagtgcacactaggcagcatattaaagtatataatatagtatatattatatactatatatattataaagtaatgtattacaaagtaatatattactatatattataaagtaatatactataattaatatataagtaatatactataacacatataatatataacaaatataacatataacatgatatattatattatattatagtatagtatagtatagtatatataataagatactactggctactaatccatccaaatctagaatgaaccctgtgtaaacacacaggaaaacagtgggaaatctagtagaaaactggacaataggtattaataggaaattcacagaaggcaaaacttttcaaaatgacaagttcatgaatggggctttatcactattaaatcctttaaaatgcatttaaatgccaaggcgatggctcagctgttaaagagcttgtggggggatcaggaggaccagagattggatcctagtatctgggccaatgtcagaaggatgtggcagcctgcctataatgctagctttggaaggtggagtcagggtatccccagaacaagctggctcgtgggattagccacattggtaagctctgggtttaattgatagagcctgaatcaatgaagggaggagagagtgacacaaagagactcctgatgtcaacctcaggactctcttcatgtatgtggacacatgtgcatgcacccacacacacgtgtgtccacatatttgaaaacagatatttacatacaatacacacacacacacacacacacacacacacacacacacattcaaagtaagtaagtgcataaaaatggttacattgtagcagtttgtatatgcttggcccaagggaagtggcactattaggaggtgtggccttgttggaggaagtgcatcactgtgggggtgggctttgaggttcttttttccattttctctatttgatttgattactacagccatgaaattatgatgatctacatatacagattttatgacaagaaaagaaaaattcataaaaattttgaagctggagcagtgattctgttggtaagatgcttgtaagctctgggctcatatccacttatcagtgagtgcatatcatgtgtgtccttttgtgattgggttacctcactcaggatgatgccttccaggtccatccatttgcctaagaaatttcataaattcattatttttaatggctgagtagtactccattgtgtaaatgtaccatattttctgtatccattcctctgttgaaggctttgaggttctatgtttaagctctactaagtgcagaagaaagctctcctggttacctttggatcaaaatgtagacctctcagctccttctctagtaccatgtctgcctgcatgccgccatgcttcctgccatgatgataatggactgaacctctgaacctgtaagccagtctcaatgaaatgttgtccttcataagagttgccttggtcatggagtctcttcacagcagtaaaacccaacaaatatcactaagcaatttttaaaaataaagctaagggctagtgagacggcttggcggttaggaatgcccgctgccaagcctgaagacttgatgagtttagtttccagaatttatatggtggaaggagagaacaaactcttagaactgtcttctgaccttaacacacactgtgtgctacactcacgcctacacaaatgcatgcccacgtaaacaaatagatgcgaaagtcaatgtaaatacaattttttaaaaaaaaatgaataacatgcagttaagatgaggtcatattatactctcaccattggacaaaacttatatgttattgtcctcatttggttctgttgctgggataaaatgcagaccagaactaacctgtggatgaaggggttcattctgtttatagtttatcctccttcactgagggaaggaaaggtctacatcacccagaggaagaactgaatgaagcaaagaccatggaggaatgatgcttactggcttgcccccaggctcagggtcaacgacctttctcatgcctcccatagccacctgcccagggatggcccagctcacaatggcctgggtcctgtcacatcaatcaacaatcaagaaccttgcctcacagacatgcccacaggccatccctcaaccaagatctctccctcccacatgactacagtttgtgtgaagttggtgaaaaccagctagcagtttatcaaatcttggtgggaaaaagatagagagacagaactacgctttgaggagcaacttggtggtactaagtgaaattaagtatatataattatggctaaggaaataacattcttgggttaataccttagaacatcttccataaacaaactagaggaaggtaatttaaagcacaaataggcaactaataccatcttaaactaacctacacacctacgggttatgaatggtgaccacaggctctgtatgtctactaagaaataactatgtgagtcaaaatgaaagaaccaatcgatctacatacgccagcaaggacggtttctaactgtgcttcggatcgtaaagataacaaagcaaaattagatgatagcatattaaaggttatgtaacatgtgaatataatggtttctgtggttcattgttacatccgtttatgaatgaagctgtggttggtgaatggtatgcattaggataataagcgtgggtacctggtaagagaagagatgaaaatggctggaggaggcagtgattacagttccattcagaagggaatctagagcctgggagatggcttggtaaagggcttgccaagcaagcatgaggatcgaagttcaaatccccagtccccgtgtaaaaagctaggcagagcaacacatgctcagagccgaggagtcagagacaggcagatctctggagtgcactagtcagctgactcagctgagtccctgcactccaggtttagggagacactgtctcaaacaaacaaacaaacaaacaaacaaaacagctggaatgtatgctgacttagttttacttgacatagctagagtcacgggagaagaggaaacccccaattgtgaaaatgcccccactagactgacccatgggaaagcctgtagtgaattttcttagtgactgctgtgagaaggcccagcccagcatgctgtgagtgggttgtcctgggtgctgtaagaaagcagactgaacaagcatcgggaggcaaaagctgataagttgtcccttcctgtctccaggttccttccctgatgtccttcactgatggagtgtatctgagagttgtaggctgaagtcaaccctttcctccccaagtagacaggaggttagaaagatagccctgtgggtcagagtgggtgcggtacaaataggaggatgcaccttcatatctcaacctttgcatgagcatctgggtgtagacacacttatgcctgtgacacctccttggaggtggtgatcgtgggactgactggccaccagcttagtttcaggttcaataagctaacctgtctcagggaagtaagatgaggagtgagagagtctggaacaccttctctggcatttgcacgcacatatggatacctctccacatgcttatacagtacatacatacactccactggcatgcacacgtacacatgcacaccaacaacaaaaaagtaagttgaaaaaaattaaagaaacactccatgttaacttatggcctttacatgcatacatatatatgtgcacacgcacctgcatacacttacacagagggagagattacataggcgttgtcagcagtgtgctgcagacaaagaggtatgatcagtctttctgagatgaatcttagtgatgaggattccatgatgtatgagcaacagggctgggcagtgcagccagctggtgctgcatctcctttcagtttggattatcttattgggtcacaccagaaccagggagataaatagtcaagacagactttgaaaattcatacaccacacacacacacacacacacacacacacacacacacacacacacaccaataaagctaggtttgaatgaattacttttgtaaaatccaggtctgagttgtattctgaaagctttacttgtttggactggccagtagctcagtcaggcaaaaagacaccacacgggagggcagactttaaagaagaacgtttcaatgaggcaagctgtcacggcttgtgtgaattacacaatgaaagggaaaataaaataaaactatggcgggctaaaatctgtaagttctgacatgtggtcctcgtggcaccatctgctcatgaaagcatgaagaggcttctggaactttccaggactgggttgatttgtctccacaaagctgcctgggtaagaccctgtggcactgggtcatcaagaaggtactagcagacttcctttttatctcagtatttttctacgtcagtccccaaaccatgaaacaacagggcttaccctgccacaccaaaggtcaaactatgttttctcttacccaactattgcctgggatggctccaactttattactaccccacctccaacccgtaataactctccagctctcacttcaaatccaagagagtgtggactgagtgaggggaccagagacaggtgcatctggtagaaagttatactcaattaactaactgaatgcatttgcatgtggttttaattccactgtgcagcaatttcctgagtaaaaatggagagattatatctagtttttgagtcactgtaagaattaagtaaacgtagctctcaatctatatctgcacattatttttcctcgtggtcctagatttctcttgttcctgaccatttgtcccgtcttggaatttccccagccttcagaggtgtagccctataatttaccgtccagattgcaatccctcttcatggcatgaattaagtcttatctcaccaggaagtgctctttcctttcttctgactcctctccctctggctttcctcttcatttcttctctacactgtttagggaaagaggtttcttagcaaatcctcagacaccccaactagtgggcttcccggaaagtctcagccgtgtgtgggaggtctgccctgaagaagttctttgccagaaaatgaagcaaggtgttctggctggacagtgagggtggtagactgtaataagtatgtctggctttaactcttctatattcatctgaggggagcatctgagcccaacacaacatctccatcgtcaatggagaatcctactcagctgacaaggcccttgcttctgtgttgaaggattacagcaatggcctcctgtttattgacctcatacttagacccatgaggcatgcatatcatagtttatttctcctacttagcaactgaaaatactaaagggagtcacagagtctgactgctctcacggtctgtatctattgcttaatcgaaagcttccctgttaccctcccatagcaaataagggtccatcccacaagacactgtggaaacgcctcctctcaagctcctccagacctcgcagtgagtcaatagagagcagaggggtcttacgtctctggtgcctaaagaggatggggtgggcgttaggtctcagcaagaacatctcttcttatgtggccagcggagagcccagaaatcttaagctttttcataagggtttctttgagacgcttcctaacctagtgatccggttatcaccaagctaagggaaaacgatcacgtgacacgaaggatgaaggaaaaccctcagattcctcctcctctgaatctgggagtggaaaactgaggagctgagctcagagttccagagccacgcgaagctgggctcagcagtgtttgcagctgcaggtctggtgagcctgtggaaagagagaagggtgagagaagagagtctccaaaaagctgcccgaattagagaaacaagagaccctgcctcaaaaaggcagacacctcaagtggtcctctgacttctgttcatgtgtcatgacacgagcatccctgaatccacatacacagctgagaagcgtgtacacacacacacacacacacacacacacacacacacacagagagagagagagagagagagagagagacagagacagagacagagagacagagagacagacaaagagacaaagagacaaagagagagaaacagagagtggctgaagggagggggcaggggaaggagggagggggagggggagagacaaataatttataaaaggaaaatcatttaaaacatttcagggctgccgagatgacgcagttgcaagcaggaagccctgagtttggagccccagaacgcatccaaaagccaggtgtggagcgtgtgtgttctgtatctcagctctggaaacaagggcctcgccatctattgccaatgggctgccaaaccaacaaggagcgagcaagccccacttttcacgtaaaatacctcaaagagaaaagcaacagatgcaaaggggagagaatctcgcttttgcccagatcatgtagcagccccgctcttagaggacgtactccatgtctatgtgacttcaactttcaattctacaaaaagggttggtttcatccctctcttctcaatctggaaacagttcgttttaacgacagatgggtgatattacacttagaatcaaactgttaagccatgtgaatgaatttatggtcacgtcatttcgaagcgtcccctctacaacccccctccccccgctgggaaaagaggggcttcccgctttcccaggaagggaagctgtgggctctgctgggggacacacactgagggactttcatcagcatccctcccaagagggaagggacatgtctgtgggccttatggtcttcaaagggacgtaaagccgttgcattctgattagtttgtggagggtacttgtttcaatccagctacagtttggtttgtgcagctggtatctgctgagcagctgccgggacctgtgtactctcgaaatcggtgaggctaacccctgagaagcagagggtcgggtgtcacgagagacttttctttccctttttggcagccatattgaaagattcacagacacgctcttaacttatccatgcaaagtgagactctgctcacattccctgatactttccttcaaaatgcaccaggaaatgtcaggaaataattcaattagtctcaggaaatttacaaactgtgcaaaacgttttgaatccacttttagaacactttcaatgaccacaaaagctgaagaaagggcagaaagaggcaagggaaagaggaaaggaagaaaggaaacaaacaagcaaacaaatccagtttgtcttcagaaggattatgttggaggttcgttttgcttgtagagactagttcatctattccaggcttgctttgaattccctgtataatggagacaggccctcaacttctggtccttcggcttctgtgtggcattacagttgagtgctatcacacttaattatgtcagaggcgtttttgtttgtttgtttgtgtttatgttttactttagcagtggctggagttggggtggggttgggttactccagcagctcccaagaggatcagcctttcaggctgtcgctggaagggcagctatatagatgctgcaagaaaagcaactagctcctgctcttagagaacttttgtttattattattattaatttactttatttacatttaaaatgttagcccctttcctggtttccccttcgaagaccccctatgccctctcccctccccctgatcaccaacccacccacacctgcttcctggccctggcattcccctacactggggcgctgagccttcactggaacaagggcctctcctcccattgatgactgactagaccatcctctgctacatatgcagctggagccatgagtcccaccatgtgtactctttggttggtgatttagtccctgtctgggggtactggttagctcatattgtttttcctcctatggggctgcaaatctcttcagctccttgggtactttctctagctgcttcattggggaccctgtgctcagcccaatggtaggcttcgaggaaccacctctgtatttgtcaggcactggtggagcatctcaggagacagctatataaggctcctgtcagtaaggtcttgtactcagctattaaaaagaatacatttatgaaattcttaagcaaatggatgaaactagaaaatattatcttgagtgaggtaacccaaccacaaaagaacacacaaatacgtggtatgcactcactgataagtggatattaggccagaagcttggaatacccaagataccattcacaaaccacatgaaactcaagaagaaggaagaccaaagtgtggattctttgatccttagaagggggaacaaaatacccatgaaaggagttacagagacaacgtgtggaacagatactgaaggaatgaccatccagagactgccccacctggggatccatcccatatacagtcaccaaacccagacacttttgtggatgccaacaagtgcttatggaaccttttatctatagagaaggtttctcagctttggtagcattaattaattcgttgtcatggaaaggtgccgtttacaggcatcccttcgcctctccctgtagttgccagaaacatcttagatatggatcaatatcttctggggccaggagatattcccaaattgagaaccattggtcagcactctgtctatcatgactgcaaacaaattgaaaacttgacaaacattaatgaaaacttgataaacattaatgaaaagaaactcagaaaacactttgatagtattttctttaagacatgccatgcgtggtggcgcatgcctttaatcccagcactcgggaggcagaggcaggcggatttctgagtttgaggccagcctggtctacagagtgagttccaggacagccagagctacacagagaaaccctgtctcaaaaaaaaaaaaaaaaaaagacagggtctcatgaaacccagactggccttgaactcactatgtagctgtactgcctgggtttgtgtgtcaacttgacacaagctggagttatcacagagaaaggtgccttccttgaggaaatgcctccatgagatctagctgtaaggcatttttttcaattagtgatcaagggtgggagggcccattgtgggtggtgctggactaacctgggctggtagtcctggattctgtaagaaagcaagttgagcaagccaggggaagcaagccagtaagtaacacccctccatggcctctgcatcagctcctgcttcctgacctgcttgagttccagtcctgacttcctttggtgatcaacagcagtatggaagtgtaagctgaataaaccccttcctccccaatttgcttcttggttatgatgtttgtgcaggaatagataacctgactaagacagtagccaacgatgatgctgagcctctgattctcctgcctctaccttctgagtactggatttacataagtgagctgtcacaccagtttatatggtgctggaatcaaaccacaaaggctcccagcatgcaaggcaagcattctctcaactgagctacagcctcagttttagcaatgcaaagaagaggaaaaggagggagaagatatatatatttttcattacatatatctcacatatattttacattacaaatatctcacatatattttaaagcgctgtagtggtgagatattgggctttgtagacaccaggcattctgctgtcctggttcttcaggctttatgatcttgaacaccatagttctatttggtgagtctgttttctcaggagttgttgactatgcctttagtccagtgctatctgaagaatgaagatagtatctctctcagtacacctttggcaagggaagataccatctgcccagtatcatcatgtacattggttgagagttaactctgtgctaagtgttgtggtaaatgcattatttcttattccatcctcatggcaatcctaccaaatgtcaaaaattattatccacaatttgtagataagaaaaccaaaactttgacacattaaatgactgtcttaggattttgttgctgggaagagacaccatgaccaaccaaggcaactgttacaaagggtaaacatttaattgtttctctgagcacttctgtcttccaggattctaccacaatggcctttctgctctatttacagtattcaactgtttttttagtacaaagttccaaggtcgtccacagtcctgcaaaaagcaacacaatcaggtacttcccagcaacggcgattcttgagtatcgatttctgtattatttaatcttctgttgctgtgataaaatgccacgactaaggcaatttacagcagtaagagtttatttgggcttacatttgcagagggataagcgtctctcatggtagggagattggaaggcagtgagtggggcctgacagctggaataggaagcagagtgatcacatcctttactgtgaacaggaagcagagacagcaaacagaaaatgggctcaagctaagaaaagaactctcaagtccagccgccagggatgcgcttccttcagcaaagatgctagctctccaacagcatccaccatctggggaaccaagtgttcaaacacacgggtctgtgaggaatatgcttgaccttaacaaagctagggaaatgtgtagactcctctacacagctggaagatgttcactctctcttctttcctttaaacagtttcttaaaaattatataacccactcatattttcctaggtgttacaatcataccttacctttaatcacattttcatttatttgtttgtttgagattttatgtttaattatgtgtgtgtgtgtgtgtgtgtgtgtgtgtgtgtgtgtctgtgactttgtgcacatgaatgtggtgcccatgggagccacaagaaggcatcagatcatttggagctgggaaagcagagccggaggcagggacatctggcagagttcagagtggacatgactagactgagctgggtcatgtggggagatgtgcagaggaagggaaaggggagagatgggaacaaggtgcggcaggcaagagagcaaagatacacacacacacacacacacacacacacacacacacaccacatatgtacatatacacatacacacatgcacgcacgcacacacacacatatttagatgcattgaaatcatttgatatacaaatagaccatgcaaagatcaagtcagtgtgatggacatttccagctgtttaaactttttaatacttgttagtattgagagtcccacccccaccccatttcactgctttacaaagatacaaaacattgttctgggcatgttgggtgcattccttaatcctagtgatgcagaggcaggcagatctcggtaagttgaaggctatcctggtctatacagtgcattccacgctagctagggctaccagtgagattgtttcaaaaaacaaaagtctgtagttatcttcctatattgtttattcttctctgccttcctctttttctgcacacctgtcttctctgacactggtcagcatgtgtgagtgcttgggcccgttaatttgtgtgagcagacatgtgtcaacatcacttagaggaaaggtggcagactcattaacacacacgattaacatgattaggaccagtttgaaagcagcagttctccatcttcctaattcaggcctgactgtgtcaggactctacactctctacactgttttctcagctaacttgtccttcctgtctctcacctcttccccacactgacacacatgtatacacagcccccccaccacatacctaccccccccctacaccacagacttccagagagagggaggtggtgactacgctgtatgtgtttaactgttacctgtctctccttagttctgaatgaaatggaatctaatcttaatcctttcctgtcattattagattcatggagtcctaacggccagagtctctagatcctgtcttatgaaattcaactctcatacaaaattcaaagtatcagtttcagagaaagttatttgaaaaaaaaaactgtggagttgaaagcaattgaggcttattctggtcctcttactcagtgtgtgtgtgtgtgtgtttctgtgtatgaatgcatgtatgcatggggtatacatgcatgtatgcatgtgtgttcatgtttggtgtatgcatgtgtgtatgtgtgaggtatgtgtatgtttgtgaggtgtgtgtattgtgtgcatatgtgagcacatgtgtgtgtgtgtgtgtgtgtgtgtgtgtatgcattcagagacagagtgtgctcagcttccagtagatcctcagctaggaggtggtatcttgtgagactcttccctctgcatgctgaactgttgaccggcttgacctgtgaaggtcttgtgcaggcaaccacagctgctgagagttcatgcatgcaatagtcttcatgtttattgtagttctccctaactctggttcttaccatttttctttctagtctgtgatgttctctggatcttgcaggacaggccataatgcagataccgagttttattgatgtcaatggtccactgggctagcagccttactgactctgggatagatgctgttaaatcaatgacagtggctttttaagttacatccagacgttaggcaggaatagataactcagatataacacgaaggcttacccctgtgtttttgattttaaaaaattgtgagtgtgttatacgcaggcatggttatgcacattgatttgtgtggttgtgggatcttatgtcagagggacttagatgtcttcctttattactaccgatgttattcttttgggacaggaacctggacttcatttctttttgccaggaagtcagaaagccccagggatcctcccatctcttccttcttaatttctgggcttctgtaggcatgagcaaaactatgcctggcttgttaggtcggcactggtatctgaacctttgcttccatggttgtacagcaagtgttcttaactcatgaggtcccgatttttttgttttacttaatgctatgttgtactgtattatattatgttttgctctctctctctctctctctctctctctctctctctctatatatatatatatatatatatatagactggcttgcaccatggagtatgtgtcagtcaggagataccttttggaagacagtgcctttaaaccattgaaccatttttctgcccatcacaaattctttggactaaaaaataagagtttctttttccttaacaggacaaaactttattctctgatatttaaaatataagagaatatttcaaaatttcaaaaaccagtcccttaagttaaatcaagtgcctgctccttcacatctctcttctcttttgatgtaagcacttattgatctaaactcacttcttgaaaactcggagcatctcacaggcttcgctatgttgcctctctacttccatttgcctcaagataatttttaatttctcttttaactatttcattagcctattgattattgaggaccatgtcaaatttcctaggttttgtgcccccctcctcaccggagactttgaaagaatgtatgtgctgcaaatgacaacttagtttcttgaagtttattaatttctttatgcatatgtatattttgcatttattttcactgttttgctcaatgtttgtcattgttctagtttcctttctgttgataaaacactctgaaaagcaactttgaagagaaaaggacttgtttagtttgctcttccaggtcacagtccattactgagagaagtcaaggtaagaactctaggcaggatgcgggagccgtgagggagtgttgtttgctggctgactctctggaatgttcaaactagttttattatatagtttgagcctgctagtctagggatggtgctgcccacagtgggctgggtcctcccacatcaatcaatcatgacattttctatgagacacggccacaggacaatatgatcaaagagatctctcaattgaaaactgaaaaaacttcctcttcaggtgaatctacgttgtgtcaaggtgacaacttgtccagtagtactaagcagggcagtcatctttaatcagagagatgacagtatatattcccttactgtatgggtttgtgttgagacacctataatggcagacagattaagtcttcctgcatctgctcagagcccctgtccaaacagttccttcttccctcttgtctctccttcttcagacagcctacacaattcataagcaggagaaaacatccataggatgttttccagttagtgttctagaatttcagtagtagaaaggatataaaaattacttagaaacagggagtactcaatggcaaagtgcttgcctggcatgcatgaagccttgggtttatcacccccccccccactcttagtccatatttatcatctttcatttaaggaagcttaaaataccagaggactagagagatggcttattggtaaagagcacttgttgctcctgcagaggaccagggtttggtttccagcacccacaaggtggctcacaaccatcagtaactctagtccaggatgtttgacatctttttctggcctctgtgggtactaggcgcacacatagggcatatacatacatgcaggccaaacacaaaagtaaaaataaaaaatattgtctaaaagctatctcagacacagggaagtgcagagatttatcctaaaccacactgttggttaatgtgaaagtcaagctaagataaataaataaataagtaaattaattaattaattaataagtaatagagggttggagagatggctcagctatttagggtgcctgcagctaggatgcatgttttgtttccaggggattgggggcatgagagaaaccttacaacctgctacagggaattggacatgctctcatggcctgtgaggatacttatacacagaagacattctctctctctctctctctctctctctcactctctctctctttctctttctctttctctttctctttctctttctctttctctttctctttctctttctctttctctgagacaaacacacacacacacacacacacacacacacacacacaaataaaaacaaatcttggcttatctgtgcatcctttaatttcatcactaggaaggaagacagatctttacaagttcagggtcagcctgatctacaaatcatgttttagatcaacaaaggttatgttatgagaccctatcctgtctcagagaaacaaaacaaacaataacaaccgctcccccactcttatggtaaaatgaaaagttactaaaggtaggacacccaagagcacacgggacgaggatttctaggcaagcatctttgtgcagtgttgcacctattattgaccagcattgtttcaggaaatgttaggcagaatcaccccgctgttctcggaagcaaaacagaggtgtcacaccttctgattagactggccagcttgcttttcaaatcatctcttctttatcatcaaagagagaaggaaacctcggaacaatgctgtctctgcaatgctatccccactcgatcttatccaaggctgccgtctttgttgccatagccacggagacctgatgcgcaggtatttgatcttgctatgtgccactgaagggtggatattccatcggagaccaaagaacaggaggttgttaagtgtgttgtagggaatcagagccatggagaagttgtttgatctgagtccagggctgagcaggacattggtacatcctggatgaaagctttacggtttgtacacagcttggagaagtttaagtcttggaaaagccgggcagatcccatgtgttaactcctccattgctgccagcctttccaagcctgtttcacttaacaaatatttattgagcgaggtcattacctccaattttcactacggagacttgaaaattaagacacgtactctgcctttgaggacctttgaggcacacagatgtaaactggccattggataatatcatacatgacacgtctgagacacgtgaggggaaagtagaaaagggtctatgtctcatacagcaaatgtataaagttctgtaggtaaagtgccatttgacatggctcctaaaagtccccaaagatagatttatttatttatttatttatttatttgcacatgaataatcaacttgttgaaggactgagagaccacagaaaaacaagcaggaggaatagcgaccatccaggaaagaggcttgactgggcagaagggtcaaactccaggagacagaagacaatttgaattaagattagccaatctcagagattccttatgaatggcttgatgataactcctcagtcttagccagtgggaagttttctaggaggaattctgattgggcagatctttagccacatgcaatgcccgagggtagaagatgtgtcttcttattctgggcagccacactgtcagctgaaaatagggtgtgtgggttgtcatgtggacagtggcagttcctataatccatgcctacctgtgctgtagctgcactccttgacttacacacacacactctctctctgtttctcccttcctcccccctctctccctcccttccctctctccttttgcagaggtgggtattgaacccccgacctcgcacgttatgatagacaggcacgtatccctgggcgctatgctgtactattaacgatttgtatccctttcctctggagaggagatggcgggcttttcaaaagaaagaaagaaatattcttactctatctatagtacccaacagtgtctggtacacctacatacacagatatgcagggcccgtggaaacacaacaattccactcctgtttaggcaacttttcatgctctttttttccctctgaacttggcttcatacagtttttagtgttcaaccttagtcttgttaaatccactccaccatagctcagcctaatcatcggcttttgaatggatttacagaactagacacacatttcctcctacagagcagaccttacgtcccatcagaaagcagttggttacacccaaatgttgtatggccctccattaaaaaagatgagcttatttgttttatgtgtgtgagtgttttgcttgtatgtatacatgtataacttgtgcatgcctgatgtctgttcaggtcaggagcaggtgtttgctggatctcctggaactggagatatagatactatgacctgctatgtgggtgctgggaatcaaatccaagttctctgcaagagcagcaggtgttctttttttaagttaatattttagagaatttcatacacaaatactgttatttacctcattaccaccccactcaacctggatcctacccccaaccactcccttctaaaatttatgacttcttcatttcttttttgagatttatttatttattttatatgcctaggtgcttctatctatgcaccccttacacggctgatgctcaaagaggccagcagagggcgccaggtcccctggaactggagttagagatgacggtggcttttcctccctttttaccaggagacctagtcctcacagaggttttcaggtcagttccagtttgattccttcaagtcctgtgtccaaagtgtgtgttgtctttagccatacgcgtttaatgtcaagttctgggaggcaccaaagagaacagcagaagccgctgggacttctctgaccaacagcacggaggtttttcatacacggtactagatagtttttggctcttgcagggagcattatagcccaagctggtgtaacaccatttaaagcacacgtaagcagtatatgcatatacttacacttgtattcatttatgtattatgcatgtgttctttttagagatctattataggtgtatgaatgttttgcccacatccgtgtacatgcaggacatgtgtatctgatgcctgagagagttagaggagagggcatcaggtcccctggaactggatttacagacagttgtgagcagccacgagagtgatggagactgagcctgtgtcctctacaagagcagttactgcttttaaccactcagcctcgccccgctacgcgtggatttttaagtaaacacgaaataaacttttcctttcgccttttcaaactcactttgtcttatttatgcctcttccctcttttccctctattttattcttccccctcccattaaagccccacccccttttctattcccccctccctttttgctaggacacagcaagtgctcttaactgaggagcagtctctctagaacccccgcccacgccacacatcttttagagctgaaaatttcctacagcttccgaaaggaagaatcaggatagagtttagaaatataaccaacagaggagaagatggcaaaactactgctgccttcagcacagagaggctttacctagaaaatggggggggaaatggaaacatggaaaaatgcattgattggaaatataccgaggacatgggaagttttaagggtgatgagcttgaggcgaggaaaccagatttgtacagttttggaagaaacatgcaaagtttaaattcggctggggatcagaggcagttattttatggcaaagatgagattggttttgtccagcttggcctcatttgtacctctccattttagctatagtcacatcttattaatacttacctcactctttggagcttaggcagaaaatccattatttatggttgagtattcaccatttatgtgtaagtaaggacatctgtatgccattgaatatgtggttgtgaagtaattaaaacagtttacagtgtaaaatgaaagacatttctctattttaaacatgcaatagagaaatggcattttatatattgtttagaaagatttatttatttatttaatgtatgtgggtacacactgtagctgtacagatggttgtgagccttcatctggttgttgggaattgaatttaggacctctgctcgctccagccaaccccatttgctctggttggccccacttgctccatcccaaagatttatctattattataaataagtacactgtagctgtcttcagacacaccagaagagggcgtcagatctcattatggatggttgtgagccaccatgtggttgctgggatttgaacttaggaccttcggatgagcagtcagtgctcttacctgctgagtgctgagtcatctcaccagcattttatattctaactagattcaatagacacttttgttttgttttgttttgtttgttttttgtttgtgatgaagaatactaaggggtttttacttagttagcagtaagcaagatgaactgaatatattgtatcaagaggcatcgagattgcatggctgtaactcaggtggtgatgaaggaggataaccatcccctggaggctaacctgagctacacagcaagacccaacccaaaagcagccagccaaccaaaccaaactcaaacccaaaggcccgtgaaaaattgaattctgatgattagtgccccataaggaccttatggaacatgaaaacaataggaagaacaaagagaacgagcaggtcagaaccacacttacccaaattaaagtctcccagcttggaagatcaaatcatacattacctcaagtaactcatatttgtctgcaaggtgtcagctgaccccttttctttaatatctcacttcccacccccacccccttttaaacagaaagacctttgattgtggtggccaataatttgaagttttgaagaattaattggccctattatacatgaagacatagtaatcccccttcacttttggaagcctcggagagagtttgagaatttcaagttgaaatatcaccccctttcacaaaattctgtatttaaggatagtatttttcagaatttaaaaaaattttttactggaaacttaatattacagcattccccttcagggtttatggtcaagcttttttaaatatatgttttatttctttaactggcagatgtttgaaagatgagagtaggattaatcctcatattaatttttaaatacatctcattcttccaaagaatgccgagaaaaagaaccaactctccatgtagtaactggcaaggaaggaaatagggctcctaccatggcaactccctgtcagggatgcttagtgttgtttctgtccaggttcctcactgctgagaacaaatagccaacaatactgagagacggggaggtttcttctggctaacagtttcagggatacagttattgcaggagaggagaggagaggagaggagaggagaggagaggagaggagaggagaggagaggagaggagaggagaggagaggagaggaggcagctggttaaaccgggtctgcagtcaggaagcaggggagccacacataaatgccgagactacacttgctttttccttttgctccactgtgagaacacagcagacctcaaaacacagcagtttgggaaccaacacacacgtctctttgtgtctggcaattgatgtaagctccatggtttttgctttttttctagctcctttaattgattgattgattgattgattgattgattgatttctgagactggattttgctctgtaagccaggcttgtgtagaactccaattttggctggcctggaattggagaagttcatattctcattatacagagtgcttaatggcaccgttatgctcaggtcattcattcattcattcattcattcatgcatgcatgcatgcatgcatgcatgagataggagttttctgtgtagctcagaatttccctccaacttcaaattctccttcctcagctttcctggcaatgaaaatacaggcctgcgccattatgcgcaagttatattggctgttgttaatatttatgttaggaaaagaaaatagtctctgttttacatacaatctacttggaatcattttttttttttaaagttaagtcggggtgaggggtgtgtgcaggttaacaagcaaacgcaattcctccagctaacgccaaggggcaccctctccttcccctcggtttctggagcgccttgagttctttccatctgcacaaagagcccggcctcctcccgggtgacatcacaaagggtcgttctccgccccttcggcgccaccacgtgtgtccccgagctgagtggccatccgactcagtccctcgccggccggtctaggcagcggaggaggcgagtgcttgatagtggctggaagcttcgctatgggaagtcgctctttagcactgtcgcggctagccctgctctctggttctccgcagccgctgtcgttggagagcaccgggaggcgcgggttgcgagcgcgcctgcttctcaccgcccgggcgccagcgcccctgggcaggtgctgagcgcctttcggagcctcccctgctgcctccctcttccgcctgggtgcctggctgctgcagtgcacatgggctgctggaggtagatgggctcaccgcccgtgaggcggcggtggatgcggcgctgggcagaaacagccaccaattccagctgccgtggggccgagcgccccgggcgccgctgcgagccccgagctcggccatggggacccgggcaagcagcatcaccgccctcgcctcttgcagccgcaccgccggccaagtcggagccacgatggtcgccggctctcttctcctggtgagcgataggaggggaccctagggtggcggctacgttcgagcctgtgtccgggagccgggcgggtcctcgggcccgtagtgccggaggcgcgcggtgggaccagacgggttggaagggttggttacaaggcaatagccagaccgaggaggactcctactagatcgtgtgtgtgtgtgtgtgtgtgtgtgtgtgtgtgtgtgtgtgtgtggtgagctaaggctagtgagtgttaaagaattatttttcttgcaatctggctgcttgaaggaggcgcgagaggtgtccgcctcgaggtcctgcgcatttttgggtttttgcccccgactcggcctatctcgcaccccaacacccagcctcaccccaatatcattcgctgccagaccctcggcgcggtgcgaggcccgagtagtcctgtcagtagccagctgccggttgtggccgctcctttgtcgctactgcaatgtcatgtccggatgctaccgcagtggagacagccggatcggtgcgctccggacgcgagcaaccgctgcatgcttccgcgcgcgaagctttccggagtagggcgcaggccaccccttgcttcagcttccttgcttctctcctccctcttagttcagatgggtcctgatttctgcaagccaaaagaagaagaagaagaaggagcccgggtgggtggtgggggtggggtgggagggggaggaggagaagaaggacccagagacccaggcgcctctaaagcacaggcttggagccaaccggcgctgtggctctcagtcgagggggaggggaaagagctacataaaggacgattaattttccccatccttttcttatttctccctttctgtgtttagacatgtcaccaagcaagatgatgcaggctctctcagcacccaaatctggggcgtgcccggattgcaatcctccatcactttatctgatcaaaacctgacatcatcccttatccaaaacttacccccagctggccctttatttccaatattggggccaagtggggaattaggtggaagaaaatttgaattcaaacccttgagatgctataaaccaatcatgtctttcatccctgcagggaggatgaaggttgttagctaaaaactaaacaaaaacaaaaaagagcttgttttcatggttgggctgtgtaagggaaggcaggcctcttgtctccttcctctaaagggcttactgcctggccagccaagatctactgcttccatcccaaggcatgacagttgctatggcctgggaattcattctacagacattctggttctctctgtctctctctgtctctctctctggctgactctctttctgtgtgtgtgtgtgtgtgtgtgtgtgtgtgtgtgtgtgtgtgtgtgtgtgtgtgtgtgtgtttagggagagagagagagagagagagagagagagagagagagagagagagagagagggctaaagaaagtttgttgttcttagcatttatgaggtaaatctcagtgtcccttgagagacgcttttctgtctttttataacaatggcaaagtccaagccctttaaacaagtgtggatagtaaataatcagagagtctttgggaccgtggacttgaattgacagtcttagattgaacgagttcaaggaagcactgatcctaatgacctgagttaggtcccttgctgagttccctccaaaggtcttagacctgcttccgtgatgagcatatactgccgtgtgtccctgctccacacagatacaatccttatacaatacttatagatcagtccactcaaatccaatctaaagttagtgctcaatgtatagtcgtaatctggaattattttttaacttttagcctgatatataggtccttgaaggtctcagcatagtaaaaccatatgctttaagtaaccaagaaagggcctagttctttttattaaatgatcaaactcaatgtacccacagattgcacccagatttgcaactgatgacctacagtataagtttgacagtttgatgaagtttatgaaaggtattttagagacaatctcaaggtgacgatgctacagggttccttgatttcctggtaactatggcaaaagggctttctttaaattgatggagtaggaggagggtgagctgaccatcctggagtgtgggaatactccaggaaacatcaggagctatgcaatgaccttctccatccccactttggacggtccagtcatcaggacgggccctgtttctgtatacaacagtgatctggtgactctgttctcaggagaattggtcccattggtaatcttggccacattaacagcagacaccaggtaggacagctcaagtaaacatggtgtgaggtacctagaagaataatgggggatacaggaaggttaatgctatgtatatacagggtggttagataaagaaataatgatggcttccaattgcccttctctcatttttttttcatagcagtctttgttgttttttgtggctcttttttttttctatcagcatgaagagcttactataggctctgatatgtatgcctatcatatgaacttgtcaaaagagcagcgagctaatttatacagaatatgccactatccctgtcaaacgggtgtcacctccattctacggatgagaaaatagtctccaagaatcttactggtctgttgtagtatgtggtgactctgggctggaactccttggctcctactctctctcacccacgtaccacactgcccgtttcacaacttcaagttgtttggtgagtgtaaggacagagaaggactgctggcaggtagctgagacggtggcttgattaattggggaatataagtgagacgttcacaaggacctttggagtgagtcagtctagttgctggcatttctattgctgatgtgttgatgtgaccgtgtcatgtttggaagttactcacaaactgaaatgcagcatacacgttccaggccaaagttctgtaaatgagacatttagatctgtagtggtttagggattgtcctagaaggacttgcttactgcaatgctggatgcagtcagaggtgcctcttgcctttagggagcttggtttgactatacagatagactgattgcaagggatggtcaagggaggaaagcaacttccttggtaaagactttggatttggagctttggaaactgctgttatccacggactgagaattcctgcactgaaggcacagggaagaaggcatagcagaagaaggagtggaaagattctaaaagccagaggaacagaagttgctgtgagatcgtgtcacctggaaatgtccgggaagcttcactcatgaagtttcaacagcatggctgcgtaagcgggatctgatcagagaacaccagtggacaggctaacacagaagggggaacttcatagggcctcagccctagacaaaaaattagaaatatgggctactaaggaatatatatgtgtgtgtacaatacgtgcatatatatacaaacatatgcacacacacatatatgtatgtgaatgtaacacatgtgcatatgtattatgcacatgtgcacatatgtaatagcaattgaaaataacgccatgaatttgagtcgtgcaaggctggtacatgagaggttggctgtcgagaggaaagggaaggaagaaaagatttccacacaagaggttgtccagctgtctggccatcccttttctaggcagctggcatctcaccatttctggtcaccaaaagaaaaaataccttatttatttatttatttatttttcttttgccggtgggaaatggtcagacacatcatcagacacatcatcagacacatcatcttgcttagagggtcccaagtgttactgttggccactgctcctgagttctaccttctgacttccaactatcacagaaaatggctatctgcctgggcaggagtgtacatgtgaggtcatctggggtggggtggggcactcaagtcctagccttggtgacaaatccaattagaatatgaaatcagagctggcgggcatacagagggctctctccctttgatatactttaacacagcatcctagactgtggaagctgggagggaagctaagctgttactgatctaacaccccacacagcttggctgagggaaagaacagcctccactgcggaagtgactatttttcattttaccaaatctacatggtgcagaggcgggatcctaagcagtggaagcccagtgatgaagtgggattagaaccttgcgtggcatgaagctcatttctgtggcttataaaacaagtggccggtgtcaatggatcaatgggtgagcatgctagaccccgagagagacacagatgtgatgttcacatcttcaaaatatgtagtctgtcagaggaggaaaacacttctattttggaaaactttccaatcttggaatgatatatgctagttgatttatgggaaattgttaatgaggaggaacaagtaatccagatcttctactggattgaacaactcctgatttttaacccataagttatccccacaaagtttagagtagggtcaagctttctcatttggacttactgtatatctctggctatcagatttagtcacagacagacagacagatagacagatagacagagtctccaggacaactaagcaattaagatgaatctacaagaaaaacctctgtagttacacgggcacaggtccactgactacttatacatctggacaatgtctaccaattagataaagcaaccatagtttgccttccccagtggtcaggggtgggtttggcttcagagctgggtctagtgagtagctggtgtcttctctttggaatttggggacatcacatcttgacttttgcacttgactccatcttgaggagaggcaaagcttcttgggaggcttggtagaaaagctgcaaattggctctgtgctaactcagccagcaggcaaactataattggcttacataaagttcacgattattattattatttttttttcttttggtgacgggaaacggtgagatgcatcatcagactattcaagggccaggacgaattgagcgacttttccttgcgtaaacagctctgcctattttccagaaagcactaatactctgttggcttgcttcccccctgcacaggcctggcaaattgcggtaatgccaggtcaccaccagcaacttcttggcaatctcaggtgcttctcttctgtgactagaagggcccagattaactggtgggtatccggtggtcatttggagttgagtccatttggagcacgagatgcagatatattggatggacagaatgacaactgaagccattagtaggagcagcttggcccactgagtgtcagcaggaggctggacttggttgtttctgcattagaggccactgagttgtgttctttaggaatagaggcgagagatggtggataaacactggctttctccagtgtttatatttgtcaaatacctaaaaatcaacaggatcttaaattggcttgaaggctgccacctggttggacagtgattattaacctggagggagactggcagatgatcagaaatatgggtggggcctctgcttatggagagaggttttgatgaccgtgctgttgacagaaggcagatgcgcaatcaacattcatgaagagtgctgaagtcggggtcgtgtgtgtcctggttggaggcaacatgtctatagtgttaggaaagttgtgctcagggggctctcaggaaggtgtgggatgcagcaggacctcggtaagctggcaggatgctgccccatgtcctttgatcttctcttcagaatggttgcagactatgcatgactcgtcgcaggtctaagacaaataaaaagaattggagagaagcacatagccaaatcagaacacggctagtagagctatgagacaggcctatatcgtgttccattcgctctctgcaaccaggatcactgtagtggctctgttgcttggcaccatttgcaaaatctgcttggagggaagaggaacacaggcttaatagagttagacaagaacatggagcttgtccatgtgccctggcctcaagagagcagctgtgaaatcagcagagctcctgtgttagtggcctttggaggaggactaagcaaatggctgctaaccctttatattgggatgttatttaatttatatattataaaaatattatgtaatatattcattcatatactatagaaatggttcttattactgcattgaatatcttctgtaaagcactacagtgtacattttacaagtcccagacatgacagctttagtcccattttacagaatccagaataaggtttgatagagtttttgctcagatatctgcccattattacgttctggagagagggatgaaatctagctcagcatagtttcaaacacttagctctctctgccaagagagaatggaacaagtgaacagaatggttcacttcaacttcccatacatacgtttgtttattctaaagggaatggttttacccaagaggtgaacatgcccgttttattctctgagtttcacagtggtacctgaatggtttgccaaaactactggtacttgtgagcatggtgtgtgggagctgaaaggggagggcgtggagacattgggcgaacactttcctatggtgtgactctgacgagccatggtgccacggttgagatggaaagacaccccagcaaattgaaactttataaatagggaacgggcgtgttggctctcctgcagccctgggtcactttgaaaaatatttgcttaatgagtaacagcgaggtgtgggctccactctgctgtgtagttagtttctgctcctttagtctgagcacctgaggacctgctagggtctttgctgctagcctgactctttgtataggataatagctgtaccagcaatgactagcatctgtccacatttcattccggttctcattccatggtttgagtggttcgtgctaggaatgtagtggataggttgccacagttactggagcaccctcataaacaagccgttagagaaaaaaggagagagcttcatacatgcataggatacgttttgatcaaatccacagcccttcactctctctctcccctttcaacttctcccaacagccccctctccccatcacctttccctcccaatttcacgtgctctttctctaaatccactaagtccgtgcacctgtaggtacgtgagtgtaggactatctactgccgcatggatagcctgtcaggagccccatccccaaagaaaatggagtcttcctccccgaacagccatcaattcctaacggcttctcagctaggggtaagaatttatgactccatctcctgcccacgcaggcttttgactggcttggttttatacaggtcttgtgcatgcagtcccaaccatgcacacttcatgtgtgcagggccctggcatttctagcaaatactgtttcactctaatcaaatgatccttttggatcttacaagttttctcctcttctttgagatccctgagccttgtgggggaggggctgagatgcatcggtctcattttgcacctaacactccaaggtattctaggtattctattctctgtccgttgaccaggcgtaggtctctctctctctctttttttttttttttgattcccatcttctacactgttggaaggggagggagctatgctgattaaatgagctttgagatctgttgaaatcccaatttgtagccttagcagacaaaagctggaaggaaatgatgtattagtgccagaaaagagattggagttctggtctcccaaaaacctttatgacaagaccactgtctgatttcactgcagacatggctagctagctctgctcagcaaggactcagagaggcagcggggtacgaacgagacaaggaaacttgcaggcaaagatgacaggttttcagaacagtccaacttgtatgtttgtgcttattttggccccacttttctttccataattatttccctttctcctacaggggtatatttgtgtttttcatcaacttactaaagcgtaaagactatctactaaggaacaggcatggctagggtgtgggtctatagaagtgactacaggttatctgtagtctccccttggagttcgcagaaaacgtgatgtttcatggtaatcatcataaagcagaagggagtggatttcagtggaagggaccggtatgtagaatagccccagtgtaggacagagtctgtgtcttcatctctgaccactatgactgggaagaggcagtgggactgtgtgtcgtgggacccttgaaactatgaagattcgttcagtgcaggagaagcagggtaataacatggcttgaaacattctttttttttaaaccttatgtatctccagatctcacatctccagaaagttcctggcagtcttgagacactaatatgggttctgggaaccaaatgcaggcctctggaagaacagcaagtgcttaaccactgagcatcactcccacctgccaacattgaaaaaagaagttttaattaatccttagagaattccatttagtgtattttgattccattgctcctgaagctcctcccagatcctccccaccgcttaacttacccaagtttctctccctctcgcgcctccttgcattgagtatagtttgtgttggctaactgcttttgggtatcaggccacaatcaataaggaaaaaacaaaacaaaacaaacaaacaaacctgtttctcatactgaggatggaacctagggttttcacatattgagcaagtgctctaccactgagctgtactcagctctcagatcgctccagaagcctgctggaggatggaagctggaggtcagctgctttcacagggtggagatcacagtgccggggatagtggcggtgaagatgaattttctagaatttactggtggtaagatgggagggggtcaggtggtctcaaaggaggcggactcctaggtgcctaaattgaagtctgtgattggaaggatgggctgggggcgtggcgggtagaattagaaccctaagcttctgctgtgtagtgagttaagtttgaagtgtcggcgatgaacattggcttgggccttgattttgccattttgaaatagctgactctctgcaggtccgaagcgcactgagccatcgcgactgtcgccaggcatttgggctgccgtccttcctccgcagcatccagcagcacagacatctgtgtgtagagcaatgctctgttcccccttaaggttgcttcctctgattgcattccccaaagtggcattgccaggtcagaggaaacgaatgagtggtttttatggcgttcgctgcagattgccagattgttttttaggaagacaatcaattcagccaccagccacctataaatgtgctttctagtccatgaatctgccgcgacgggactttctcatttcaaattacgtatcttctttttaattcagcgatgtaaggacctttggtggtctctgtgacagtttagtcatttctaggggcataataaacttacttgcatgatgcttgacttttaatgactcatggtccttctagcgagtagaagttatgctaatcttatttttatcaattctacttatcattctggttataggttcttactagctgtaatggcattgctttatattctattgactttttacgatcatgtttacgtatttgctttgtttgtgtgcacgtgggcatctctgtgtcacagtgcatggaggtcagagacaatttatggagtctgtgggtcctggggatagaattctctacctgtcaggcttagtgttaagccccattgcccactgatccattgcaccaatactgcaccactactgtactctactataatatcatgaaaaaaataggattgtgttattaaaccttttcctttctgggtctgagaatattctttttgttttgttttttggatttttttttttttttttttttttttttttttgcccattttgttaggaattcatcctttgacaggtagttataaagaatcctaattgctttgaattttataatgttattggttgacttgttgatatttctggatattggtgtcgtatatgtggtgggaatccccttggtgtgttctgaaggctatatgtgcgtgtgtgtgtgtgtgtgtgtgtgtgtgtgtgtgtgtgtgtaatggattctgtgggtaaacacacaggggagtgctgggcccagctgattcaccatttcaggctgttcttccgtggagtcacctgggacaggtgatagctgatatattaattgtacccgttcaggagaagatatacggagtattttctgaactctagactagggcatcagagactttttctgtaaagtgctgggcagtacggttatcttatgatatctgtggtaactacttaattccacctttgtgcaagacatgtgcagacaatgtctcgaagagtgagtctggctgtgtttcaataacactttatttgtggataatgaaatttgagtttcacacagttttcactggtgctatattgctactcattcattcctcctcatttcccagctgtcagactataaaactgttgtaggcctgcctataggctatacaaaaatagacggcgatagagtccagcctgcttttagaccagggcattaatattgtgtgagagcaaattggggcaactcactttggaaaacccttacttaatcgtgttctgggcatctaaagtgagattattaattgtaaatcctttctattttattattattttttgttataagccaaggtttatttcattttaattaattaacttactttgaggtagtgtctctggttgactaggctgacccaaggctaaccttgaattgcctccgttttaagtgctgggattatggtgtgtgctggtctcggaactcaccaggcaggcgctcaaatagctgagccagccacatccccagaatcccaagtgtttgcttgtttgtttttaatatagtgtgaaaagtagccttgctttctcttgtctttatcttgacgtctgctttaaaacaaaacttctacagtgtgctctgtgttcggggaagtgagtttcaggattataattttttattttttaacagtattattattattattggtatttttgagacagagttgctctgtgtagccctggctgtcctggaactcactttgtagaccaggctggccctaaactcagaaatccgcctgcctctgcctcccaagtgctgggattaaaggcgtgcgccaccacgcctgcataatcttttattaaattaaataaaagaaataaccaatttttggtgtttgaggaagaatatccctatggaaatcagcttgaataggaaatcagtgtctagcacaagctggccttggattttgtgatgttcccgtctttccatcctaaattctgtggtcataagtatggaccaccatgtaaataggcaagtaccactagtacataggcatgcatccagatggcagttcttttcttatttgcttgttctgagccagtttgggtgtggatccctgcctcactttgaatacactatgtatatccatctggccttgaactcactaagtacaccaagctggctttgaactcactgcatacctcaagctggccctgaacttgggatattcctcatgcctttgttcccaaagtgctgggactacagtggatgccactgtgatggagttgggttacacctttaaacaaaaaagtctagagtttggaggctggaaatgtaacctgcctagcacacagacaaccttggacttaattgtagcatgacaaaacaaaacaaaacaaaacaaacaacaacaaaaacaaaacaaacagcaacaacaaaaacaaaacaaaacaaacagcaacaaaacaaaacaaaaaaggaaacatttctcaaatttatacttaaaatagaattgaaatgttttaaaacattgtctattcacaggtaataaacttaaagtctagtaaaataataaattggtggggtgataatttcccaaactggtattccatccagcaattaccatgtcagacatgttctccatactccttctgtgtagctaattatcaaaacaacttagaatggccgttgttattgctgtgtccattttacaagcgaggaggtagaggcttggacgttggctccttcccaggttagaaagatagaaaaaaaaaatgtaattttcttcagcttaggaaccagattcaccagctgacactcacagggtgtcttcaattcacacccgaccctatttgcttcaagatagctaccggttggaaggctagattccacaagacggactctaacggacgtcaggtatcaagagtaaaagtcaggttataacctgtgctttctgttgtctgactgtaagtcagagttcctatggctctcagggggttcagttaacttgtaagcatggcctcacatatctcagggaaacactttctgaatatggctctcttctacagaaaggagacccatgataaagcatgcagaggaaggcatgcttagggcagccatataaggagcaccgtggagctgtggagctactgtgtctgtctgccttggacaccgtgagctctctgaaccttgtcctttcagagttttatggagatgctatttcataggcacaatttactacgtcattagacactggtgactaaacttaaccttcaacccctctcctcatcccagagattgaggtagaactgaaagtagcaagctgaatataaaaaccttgtgtgttctgaccactggtctccatcttggtggcaccctctcagagcctccgtcccctgtcattttatcaccacccagaagaccctaatcacgctggctgtgagcttccctactttgtaggatccatgggaagagaccacatctatattccttattatcacaggatcgcggccagcagatacctgggcgagcagggcgtatgtggtacattctaggcttaaatggtttttccttatactttgaagcctcagttgctgcactggcctgggttgtatgctcttccagacatgcccagtcagcatgaagttgcatccttccatcatctactgttttctatgacatactatttcacttattactcactgggcatcctattggcatctctcagtaagcagagaataaagaaattactactgtgttggagggagacggggctgtggtccagtgactgattgctgtatgcactttctcttctgcattgcgggttccagagaaaacagctcctaggtgaaatcttccctgtttttttcctctccagtgtcccctgagcttgcctccttctgttcctacagtcagcacattctggctctggcattctctatagtcaccagcttgaaaaacagtccctgcttcctttgctttggcaataggagacggctctccctccttcccattcctctcatccctcccatcctcctcttccttcatctctccctctcttccatccttcctttcttccttcctctttccttcttttcagagaaggcagtagaaatgaaagagccaaccaagtttatataacataactggaaataccctgtctgtgatttgtggaacctttgtccttgaaacgtttgtttgtatgtatcccacctgccccacaacttcagatctggggaattatagccatccagtgtttatattacaaattaaaaatgatggcccagctatctggtcaacaattctgagggctgagcagctctgtctttgtcatcaggtatcatatttcatagtcatcctcataggcaaacctgattaccttacaatctctacagtaactacacacacacacacacacacacacacacacacacacacacacatatatgtatatacacacacacatacatgtgtgtgtgtgtgtgtgtgtgtatggaaaaattctatatcaaagtccagagcaattttcctgcttcttactaaggaaaagcaggtccacctctgtcttaagtttgctcgttttataatgaaatgttactagaacttgagaggaaatgaaagtaatgtctgcctggtgcagggacgatggctcagtgggtaagatgctggcttacaaatgtgaagagatttgagtttgaatccttagcactcatgtaaaaaggctggatgtggtcttgtgagcacctgtaaccccagcattatggaggctggagacaaggaggcttgctggagcttgctggctgccagtcttgttaaaatggcaagctccaggtttgatgagagagccctgtctcaagtcaacgaagtggagagcgatggagtaggacactctacatcctcctccggcttccccgtgggcatgtgcacctgtacacacacatgcatataccacacacacacacacacacacacacacacacacacacacacacacacacgctaacgtcaatggcacagatctgttgtaacctttaagctaccaagggatctcttgtttatctgaaggatgaggtaatggaagtggaattgctgaacaataagtagatgtctacattctgacatggattcacacatccgggtgcttcttgtcttcagtcaggcccacctgtgctgtaaactgcaagtgacacatcataggtgtgctataggccaccaggatgcacagtgagactctggaagccttcacagtcagtcacctgcaccaagtgctgctctccacttgatctctgcttctctcgtttaagcttctaatcattcaataaacacttgtagtgtttttggttgttgttgtttttaaccaaatacagtttgagacagcatgctgatacttgatgcatctatccactgttgtagttgacattcctttttttttttgattagatgttttctttatttagatttcaaatgctatccctaaagttccctataccctccctccgccctgtaggtgacattcttagatacatggaattttcataataatcgcagtttaaacacagagagaatctaaccttcttatattgcttataatcttaagcacaaagtgtaatcttctctttttttctttcttttaaatgagagaagaatatttgaactctttagtatattagctttttattttgagtatcacgaagaagctaattcttagaagccaattatagttctgttaagagagagtaatggggggctggagagaaggctcagaggttaagagcacaggctggccaggcatggtggcgcacgcctttaatcccaggacttgggaggcagaggcaggtggatctctgagttcgaggccagcctggtctacagagtgagttccaggacagccagggctacacagagaaaccctgttctgcattatagattccagggaagacacacagagtataagtgtgtaagtaagaaaacgatgacaaccatatagggaaaagaagaaaccgaggagggctttacaattggggatgggaggcagggagagcacccaggaggaagtcttgtctctctggatgattttgctttttctcagacgtcagggggaagtgagagtttgaagccgagtgtgaaggaaccagattgagcgtgtgagttagagtgggtggagagagagagagagagagagagaaagagagagagagagagagagagagagagcgagcactctgctcataaagaaacttatgggggagaccaggaagtttctatgagcagctggtctctgcaatgtttgtatttctttagatgcccatgctgggagctggcagatttcacctataaagggccaagtgataacagtaagctaactgaggtttctgggcagaatggtctctgtcatagctttgtcgctttcccacagtagcctgaaagcagccacgagtgctagctacatcagtgtctggactctaggaagcttgtttataagacgagctggtatgttggcattcctttgctggcccctggcttgaaggatggtttgcttattattttcctagtgttcattaggtagttgagcaagtgaggaagtatagtctgtacagtagtccctggccttgagctgcttataagcattaaggaaagataagtatatacacttacggtactgccaaccaacattaagagacactatgtaattagacgctggtacaatagacagaaacaggaagtgcgatgggctagttgctcatctgcttggcatctgggtgtttagaaagagatttaaaggctacataaggatggcaggatttgacagaatcacaacacgcaggagggtagaattggttgaatattactactgagttcaacctgctcatttcctaagtgagcaacccaggatcctgttgacttcccaacaggttgggtaagaacatgccttctcttttcaaaatctttgtccagttcttttcctgactttttctgcttgatccacccagggatgtttatgtacgtatgtttgtgtatatgttttatattgttaggggtgagagaatggggtcgctccaggttatcgattgcatttaggatgtcaaaagactgggaccagggtgatcgtgtctgctacttggactgatgtggagagaagagaagctaggtgaggggtatgggagggaagaagcagttgtgcacaatagaaaactataccctgacctatatacatgcaagaaagcagtcaatgaagtcttggtgggaagaccctctgaagtaagacatacccatcctgttggttgcgtgcctagcctttaatggctaagccagctctgtagaatatgctcattctgttgaagaactctgaattgttagagtgagacagtttgtatgttaaaacagacaggtcttggtgatgtaacagaagttagtaaaagagaaatcacagagcaacatggttggctttttttccctttgcatacacaaaaccaactcaaacaagagaacggggaagctgagaatctgtagttccaaattgctaggactattacatagatgtttattgagggggggtggaagtaaaatgctaatatcaagttatttaaaaatgccaggttaggtagagaagggggtgactctgactgtgagattgggttgtatccaaaatgtggctcaggatcaaagaattttacagtcagaggggtcttggtttagtgttagggactcaagagttagttagataccagaaacactcagattgattaaaaaggcaagaaaaaaaaaacctcacagccaaacaaaataagttcctcaccctgttgtatactcacaacgatctcagagataagacgaggtacatgaagaaagtactttcaaaaatcatctcagacagtattattttttctttttccattttcatgtgtgtgtgtgtgtgtttgcgtgtgtctgggctctcatgtgtggttccatgtgcacatggagccccaaggttgacattgggagccattctcaattgctcttccttcctatttggcgaggcaggtgcttaagccaaacccagagctcagtgatatgtgtcatctctctagcctgtttcttctagggatccgctgacacctctgtgatggaattacaggtagactgatgtatccacttgatacacactcttcccgggcaatttcagttttatactcaaaagccggaaactatgttagatctctctgacctgtcttagccatgtctatacacatggtgggggttgggagaggaatcaagggtcttaattggaaggacccagcctcggttttcttgactctcactatccatgaccttgtctcccctttcccatttgtttgtcttctcctctagggttagctttcactataatctttttatattgtgcaggggccatctttaaatattgtcttccatttggtctatttctgcccagatccatggggttagagggaagagctaatgtgtgaggtgcacatatgtgcatgtgtggatgtgcgtgcgtgcgtgcgtatatgtgtgtgaactatgtatgtatgtatgtatgtatgtagaggcatgttctcaggtagctcaagtgactctcaaacttgacgtgtagccaaagatagccttgaactcctgatcctcctacctcagcttctcaagtgttgggtttacaaacttgcgccatcacaaggggatattgttttgttttgggacaaagtttctttatgtagctcagactggtctggatcctgtgatcctcttgtctgagtctccctagtaccggcaagtacttccacaacttggaaggggaaactcttgtttagatacagtttttccttcttcttctttaaatagcacagtgggattagctattgactctggaattgggagagactttagaggaccctgtagtcttgtttgagtaataagctctgctctcaacaggccttccctctgattaggctttgcaaagcagagctgctctgtttgagacagaagtgagggggcttggagcctacctcccattgctccttggcaagaggcagccctgtgatttttgtccagttcagcgcttgcttcttgtcccactggtttcttcctccatccacttcgctaaacacagttaattcacactctcctttattctgtttgcaggagatagatgaggtaattttataggtcagcattatagtcccttaaaaactgataaaggagccaggcatggttgtgcaaactagcccagctccgtggctcatacctgtaatcccagcagcaactggagagtctgagtcaggatttccacgaggccagcctgggttataaaataagactctatctcaaaacaaaatatcttcaaaataattttacccccacgaaatcaagaatcccaaatggagcaagcatggtatagagtgtagggaatgtgcagttgctgggtggggtttgaacacagctaagtgaccccaacaagtcagacatcaggaaagaacctaccatccctgtcttagaacaaaagtctggacccttgtctagtctggtgggtgttgtcagcaatgtgcacactcagggtggctccctggatcaggagccctgggtggggaaggctggggttgaggctccatttcctagagctttgtgtatctccccagggtgcacacttttgagtctacagtgggggtggggcactaatcttgtactcgggctccattggacagatggtttcctccaccctgggcatctgctgaactccggatagggtgtctgggctggttgtgcaagtagagggagcaggaaaaggaagggccaagccaaacgctgagagaggagacttaccaccaagtagcaggatcttctctttctcaatttccaatatgaaattaaatttcccaacaagaaaaccaaccactatccatcgccaaccacctctgcccctactttcagactcagaaggaagaaaactaagtatatcgtaaactctaaggaggaaacctcaagaaccggtgagaggcggggaagtaccctggccccacataactgtggggttgggaaaagaatagactggggtcaagtttcgagatgctaagaagacagactcttgatcaccttgcaagcagttttttttctttttcttttgctttgttctttcagttaccgatgtagctgtaaatctgtaaatctagaaggaatttgttcggtagctggtagcttggggcagccatgattttcatacaaatttctccatctcactgaggatggcaaagactatcagggccttcattttgacagccccagggaagcagtcactctagtcttttgctccctgcttctctttcacagcatctcaggacttggaacttgggatacccccaggtgtgtgtgtgtgtgtgtgtgtgtgtgtgtgtgtgtgtgtgtgtgtgtgtgtggtttgtccagacagggtgtctccatgtagccctggctatcttagaactcaattggtagaccagactagctccaaactcagagatccgcctgcttctgcctcccaagtgctgggattaaaggcatatgctaccacacccaacgggtcctccaagtttttaatctggaagttggtgaaactctgacctgctgggtgaagtttttattttagaacatgaacactgagttattcttgctggacccaagctcaatgggtagatttctcaatggatgcctgcagggattgtgtctatcggttgtggccttcagagactggacaaactgcgtttgaatctaaaagcaccagctccattgtttaatgcacataacaggactgtcaaaagtatggctgtttgttaaaacaaaacaaaacaaaacaaaacaaaacaaaagtttatcatcaggtatgcaggtgctatagaaatgacaactttggcacacacctccctctttctgatgtcaagttggtgtggtacccgccagatcttgaacagtggtgatgacctgttattgctgttgctgttgctgttgctctgttcgcctctgctcctctatctgacacctctcttatttctttcagcttggattcctcagcaccatcacagcttggtacattctggtgccaagtgtggccattcccctggctatcgccttcctcttcttcttcatctgtgtgtgccgcaataaccagaagtcttcatcaggtaccgatttaaatgatccagtggtcctgcagaggagagattgggagaatcccggtgtgacacagctgaacagactagccgcccaccctccctttgcttcttggagaaacagtgaggaagctaggacagacagaccaagccagcaactcagatctttgaacggggagtggagatttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataaccgggcaggggggatctaagctctagataagtaatgatcataatcagccatatcacatctgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcccccggctagagtttaaacactagaactagtggatcccccgggctcgataactataacggtcctaaggtagcgacacaggggcactgcattctgggaatcaacctactggcggggtgatttcatttcgtttctgacttttgtgttttggtgtgtatgtatgtgtttaacagagtgtatggccggtgagtttgggttctttctttctttctttctttctttctttctttctttctttctttctttctttctttctttctttcttccttcctgaaagtgaatgtataaagcctttacaatgtataactgttggaaaatgcccaccactaaatttttttttaagttccacatattctccatttttgccttcttatatatatcttcaacactattctgtgcactttaaaaacttaacataaacgcagtgtgacttctcccatatgctgggtcccgagactctcaacttcttaaaaacctaatggcatcttgtgactcctagaagtagacataagtctttcaaccttcacacctactctttctgttttaattattattgctatttgtcttattgtttgtgctttacaagcgttcttgaggacggagggaatctacgaccctgttgatgactgtaactctattcgactttgagttgtcttcttcatgtcttgttatatagttcatattcatggctgaaacttgaccatactccctagcgctgattgtatggttttcgtctggacaccgtacactgcctgataacttgtgcacctcttaacgctactatgctctgggctggagaatgaaatctttaagtcaccaggacttgctgtttcagtggcttgacacctgggccaccaaagaactcgatcttcatcttttagggacacctctgctgcaccttggaaagccaaccttaagtgccagtggcactttatgcccagctttgctttgaaagatatctttcttgttttttttatccttctctttctctcttttttttaaaaatacacatagtcaataggtccagtctgccctcaaggccttgctgggttttcttcatcatccaatcactttcattaaaaatggctgcagctgtaagaactcttgtctgataaattttcaactatgctctcatttatctacctgccctctgatgctcagtcgtcagactctaatgcaaaggtggacgtcggctgcctttgcgtgggcgggcttagtggtgaggaactgatatcagaaaaaaaatgccttcaagtatactaatttattaataaatattaggtgtttgttacttgtgtggttttggtatatttactactgaactttcgcctttccctctgctcaggttctagccctgttcatctcttggggaaggatgtgtgttctgaaacccttctcctgtccaatctgtaaatcatgaatattattagcaaaagtcccttttggagaggtacttggaggttcactgcacagggctctgataagcactgccaagcctttcctagtctttcggagttaaaccttaggtaacttgatacctgtaggacgatctgcacacattcacaggcttctagccaaaacctcactgtccctgacgaactccagagggcttggtcagcagtgaggcggatgtggtcctgtgttggtgggatatctcaagctcactgcaggttttcctaagcttggaccccacctctgcggaattccaatgatcaaacgctagcaactttaacatcctctttttgtgagaacctggaagctgatactgtgtatactgtgaccccccacgtcaacaactgggactgtcttccggtttcactcatctctgtgtggcagctttcaagatgaacatccttgtttcccttccctcttgttggtgcatgcctttagtccattggaagagagaggcaggaggatctttgattttgaagctagcctgggagtttcaggacagcctggctacgctaactaaaaaaaaaaaaaaaaaaaaaaaaaaagatcacacatgcgcacacacgaacacacacatacagagcaacaagaacaaacaagaatgggtcagttatgatgggggaggaaacaggttttgtcaggttctcactgtgtcagaagatttagaactgagacatacaatccattcattaattactagtatgttaagtttatagtttattagtaatttgggaattttttattaataacccaaatttgtggttttatattttacaacatataaagtttaattactttattggatctttaaatttgtcttaacgggttcctattattatgcccattttacagatgaaattgggcttgtaaagctaagtatatgagatggtttcttatcactagaacagagtccctgaaaaggaagaaaagaaattctttaagggaggaaacgttgatcttaactcatggtttccaaggctttaagtccatggttggctggctctgttgcctttggttgatggtaaagcagaaacctggtaagaaaacacgacggtggaaggttgcttacctcctttcggccagcaagcagagagacacaggaagagtcttgggacaggataactcttcagtggcacaggtccagtgaccttctactagctagaaccccctccctaccttatagtctattcagctatgaacacatccatggtcgaatataccactagctgaagcccaaacctccaatagatgagcctttgtgggggacacttaatatccgaagcataaaaccaaggaatgtgtttaagccctcactgagaaggttagcaaggctaggtttgaatccgtgttgtgtatgttttgggaagaagggtagagcgagtggctgtaatctaagactgttcattctctttataagatcactgaccagaaacctgttgccacctgaaacagtgggcagaaacatggcagtgaaatctgtctgggtcatgagtaaagttcaaatgcaagttaagtaagtggtacaaacgtaggcatgagaactaaacattagcattatatggtgatcccatgatgcatagctttcccagaaggcaatgcaccatcagctactttcttaaagtacccagagtcaagtgtgatggatggcacacacctggaacccagcactcacttgcaggctggaagaccaaggccttagggtcagcctggggagagggctcagtcagtaaaccatttgccacacaagcctgagaacctttggatacctggcacagcaaagtacagggctctgtggtgcacacctacagtctccgtgttgggcagacagagacaggaagatccctggggcttgctggctggccagtctagctgaactggcaagcaccaggctcaggcaagtcactccatctcaaaaaaataaggtgtaaaatggtggaagaaggcatccaatgtccaactgcagcctctgcatatgtatgcacaaggtcatacacacacaaacacagaggaggaggaggacgaggaggaagagaaggaagaggagggattcaacgttagcctgggctacatagtaagaccctgtctcaaaacagccatatagctattggagttatagttcattgacatttgatcaacaacactgcagaaactgggtgtgacattgcatatctcccaattctttcactccagaggtgaaggcaggaaagataaaaagttcaaaatcatctttgggtgtatagcaagttggagaccagcctgggacacattagatgctgtaaaaaaaaacaaaccaaacaactgaaataaaacaaaaattcagcataaaatactaaaatatgtgactttctgattaaagctaatgatagcaccatttgtaccatagaaaggtcttctctggcttgcgcttcttcctctgaggagtatagacagctgaaaaggaaggctgctagtgtgagggcagaggagacaagagagcaaccagaagaataagaaacagaagcaactgttgggagatccaagccatgttatgcaggcaggcaggagaaggagtctgttcaccaatttgaaggactaagaaggagtttgtgacccctgggaaaagactacagactcgatccaattataatgaaaagatttgttgattagctgctagctggatgagtaatctctgagccaacttcgagattacttcgcagaagggttacggggaaggactttaaaaggagaatatcacacaaagaccttcaatatctaggcaagcaagtaacaactgttctattttgacaaattaagtgattgaggcgactcaaaacaatcttgggttatctgtgcaacaagttacagaggcaaaaaaaaaaagttagtcataacaagtgttatgtatggggaggaaggtgtgactgagtcagggttattggaaatttatcttccggggaatggagttagagactagtgggtatggaaatgaatgcctagcataaaacggagcttctttcattttcttcagagagtaatatagttcctgtgggctgttttaggctgaactcaattagatagggctgcttttcaaggagaaactgcttcaaggagaggaaggagctgggcgagcatctgtggttctccaactttcatgtaaataagtcacccgggagtgagcagcttgttctctttaaaaaaggctgattcccacaatctgattggagaggtttgtggtgaaattcaaaaatgaagcccttgcaggtttttggaccacacttagaaaactatctttagagaatttccgttcctgccaatggggacaagaacagctaagaggagctggttagactcgcaccttcagaggcctcctgtctacccttttaatgtgcaaatgagatacctgaaggtcctgctcacaggcagactctccaggcctcttctgggaaagggcagctggcatcctgtgttgctgccaagctcttgggtaatacaggcactgctgggtttttctttttccccgtgaaactgggtagtctgggatgactttacctttcaggaaaggggcagaacaaacacaggagtcgatcactcatttcacaggagggaaggaaacacactttgatgagctgaagaaacacccagaaccaagcaaatctggtcaaaacttacaactggttggggctgggcttggtaaaagtgcctgcagcagaagcacggggacaggagttcggatcctcagcatccatgttagaaaataaggtaggtgcagtgctgcatgccccatgcatgctcccagtgctggggaggcagggacagcagaatcccaggggtttgttggcttgctagctccagggtccatgagagtctgtgcctaaatgataataaggtagaaaggtgatcaagaaagacatagaactttgggcacacaaagcctacccctcctccagcaggattgtataacagcagcagaaagaaaggagacttacagaaagaaaggagactcctcgaagcccaactatttggcatttgtgcagagagctctagggatgtagctttcaagggtggacttcttcacgagcagttgtatttgggttactcatacttctgtaagtaactgcaagaaattcatctggacgcaagaagcatcatttctttgttccgttggcagtgccctatctgaggcaaatagacatttgctgtgtctctccaggaaaagtcacacaatacacagtgaggctgcctggcagaggaatcctgtttatcttgtggtcaaccagaataaaagagacaagaaaggccagagtctcagtataccctagaagaatatttccccaggtaatcaacttccctccattaggctgcacctcttaaagtgtctgctacttctaaatagtaaactggtcacaaagattagacacatgtcctttgggactcacttctgaactgtacccctgggctatgaattggtcactttcctgctgttatgacaaaatatcaccactcaagacaatctaaggaaaaagaatttgagcttccacttttggtgagagagtccataaagacagggaagagatggcagctggaacaggaagctaagcctcaatcaagaagctgagaaagtgagctgggagtagtgaggctatataacatttcaaagtgatctgcctcctccagcaaggttgtacctcctcatcaaacagtactacctacttggtcccatcttggttgcttttctactgctgtgaagatcatgaccaaggcagcttataaaaaaggaagcatttaattgatcaatttataaacactttataggggactggaaaggtggcttagtggttaagagtactggctgttcctcttctagaggttctgagttcaattcccagcaccccatggcagctcacaaccatgtataatgggatctgataacttcttttggcctgaaggcattcatgaagacagagccctcatatacattaaataaattttatgaacagcttataaaaacgttataaaacataatttcagagttaccctatgactactatggcaggaagcatggtggtggcaggcaggcatagccatggagcagtagctgagtgcttacatcatgcctgaaagatgttgacagagtgagacagggcttttaaaaacaaaaaccacgttccctgttatgcacctcctacaacagggccacacctcctaatccttccccaaacagttccaccaattagagatcaagaattcaaacatgcaaatcatgctcattcaaaccaccacagagcctacaaggctctcattcaaagcaccacaagacagcaagacctatatgaatcagacctgaggtgatggctgtagcttcctgagaaagggtttggggaatctttccaaggagccagctttgctctgtcccttacaagtagctgtctccccagctctctaggatcttcctagagattagattaggatttctcccaaacaaacacaaaaaaagtccaaatggagagggttcaaactcaacatttaaaaaaagtgagtcacagtaattatgttggggctcaaatatctatttcttaggatagaaatctctcatatttaaggtctttgggaggagaaacatgaaaaatttctggagttgtcatgcatacacacatacacatacacactatatatatatatgtgtgtgtgtgtatacacatatatacacacacatatatgtatatacacacatatgtctatatgtatatatacatacatatatacacacacatatatgtatatacacacatatgtctatatgtatatatacatacatatatacacacacatatatgtatatacacacatatctatatgtatatatacatatatacacatataatatttaaatatgttttatatatttatatattatacataaatatgcttaagtattatctatttaaatatatatttaatatttaaaacatatattataccacacgcagtcctctaaccctccattggagatgtgcctgttccgtgttagttagcattctcctactcagtcaccctctgcttcatccactgcataatgtcaaatgggagatctcacagagaaagaacatgggacagcaagttcattttcaagatcacatgacagttatttccataagtatagacacgtggatttcacatctcgtttcgtccatttgtttgaatgcagcatacctgtaggacggtgaaaggcagcctggttcctggttgagctaaggctagaaaccctactgaccctaaagggatgcttggagtttgcctggttcttaggtaccaggcttcatgcacgaggccacagccctccatagatttgtggccgtcagtaacgtaagggcaacaccgcaagccaaagcccccccccccacctgccacacacacacaggtagaggacgtgacccatggtcacctagcctcaagacacatctctattttaatgaggtacctaaaggcctggaggacttagccaataaactctccttcccagatgttccttcctgcaaaaaaggtatttaacttcaggccctccctgagaagtggggtacggttttactcagccacctttcaccattacaataaatgccttaaaatcatggattgctacttttcaccgggatctgctatggagaagaccttctttgcctacagagctaccatctaatttcttgtagaagacctctctgctctcccagccatggctgccaccaagctcaagcttgctgccacagacagccagagctcctcttttttccccctcagccctgggctagattcagcccgctggcccccactctgttctcaggtcttttgtggctctcagtatgcctgggtgtccaagagcccgagaaccagacagctagggcctccttgtaggccgggggacccccaagccagttctggctgtcctgggatctcagactgtgctttcccattctggaagggttattccatggctccccatagaccaacaccagcccggtgacagtgtggggtaagctctgtcaaaactccagcgttctgtctccccaagtagctgtgctctgtggtgggcacccctacacacacccatccacagaaacacagatgagttcttccacttagtctgagacatctgaacagctactaggttctgggctaggggctagacgtggggagaatttgatggagcgttgaaactgctgatgaggaaagagaagctctctgttcacggctctgtcctggacatccagagcaaagtatagaaatgtacttatgctataggctgaataactgagtgaatgcaagctcctgactgcaagaagttcccaacatagcaagagacacgaagagagacattcttataacaatggtaagtgatgagaaatatggaaacagtaattaattatatccaagcataatggttacattccatagaagcatttgaagacccagacaccaaatacaactcaaagaaaagtgatataaaattttctagtgtaagcctagtaatttcaatgataagttgcatcaaaagtcaggaactgatcaatgcgattctatcctcttcagagctttgaccacgataagaaatagcttgatgccagcttaacattagactctaaagcagtgaccttcctagtgctgtgaccctttaaaacagttcctcgtgttaggctgacccccagccataaaattacttcgctgctaattcataactgtagttttgctactgttataaatcataaggtaaatattgatatgcaaccctccagaggggtcgtgacccccacgggttgagaaccagtgctctaaagtgaactgcaggtgtgctgtgggctctaccacataaacaaggatgccatagcttttctactgttgttgttccccgtttccaggcttatcattaaccatcatcaggagatacgaggcccaggcatgtgacagcttagcagaagacaggccaagtgcaaccttgtgtggagctcattctctgagcaaatgttcaaaggctctgggggtgctcattgctcagtctcactttgaagcctgtactataggaacaggcattatttccactctgttgataaggaatctgagacatgcattgtgatggccccagtattatacagctagcaaagggtggagggagccaggaaggacatttgtagagctgagtgactcaaggtcataaaatggcaagtggcaagtggcaagtgaggtgacttgactcatacctgcctggaaccttttgtcttgactcaaccaaactcctccttattgattttttaaaaaaggtatctttttaaaaaatgtatgtgcatgttgcactggctggttctgtgtggcttgagttatcatagagaaagatgcctcccttgaagaaatgcctccatgagatccagctgtaaggcattttctcaattagtgattaagggtgggagggcccactgtgggtggtgccatccctgggctggtagtcctggattctattagaaagaaaggcaggggagcaagccagtaagcagcacccttccatggcatcagctcctgcttcctgacctgcttgagttccagtcctgacttcttttgctgatgaacagtaatgtggacatggaagctgaataaaccctttcctccccaacttgcttgttggtcctgatgtttgtgcaggaatagaaaccctgactaagacaaacgtgtctgtacccgcatgtgtttatgcttaccatgtgcttgcaggagcccatagagaacagaagagagcttctcaagcgatcctcggaaactatgagctgtctgtgggtgctgaaaactgaacccccatcttccataagagcaataagcattcttaactaccagacaatgcctccagccctttcttttttttttttattacgtattttcctcaattacatttccaatgctatcccaaaagtcccccattcccctacccacccatttccactttttggccctggcgttcccctgtactggggcatataaagtttgcgtgtccaatgggcctctctttccagtgatggccgactaggacatcttttgatacatatgcagctagagtcaagaactccggggtactggttagtccataatgttgttgcacctacagggttgcagatctctttagctccttggatactttctctagctcctccattgggggccctgtgatccatccaatagctgactgtgagcatccacttatgtgtttgctaggccccggcatagtctcacaagagacagctataacagggtcctttccgcaaacgcttgctagtgtatgcaatggtgtcatcgtttggaggctaattatgggatggatccctggatatggcagtctctagatggccgatccttttgtcttagctccaaactttgtctctgtaactccttccatgggtgattgtttccaattctaagaagggacaaagtgtccacactttggtctttgttcttcttcagtttcatgtgttttgcaaattgtatcttatatctcaggtatactaagtttctgggctaatatccacttatcagtgagtacatatcatttgagttcttttgtgattgtgttacctcactcaggatgatgccctccaggtccaaccatttgcctaggaatttcataaattcattccttttaatagctgagtagtactccattgtgtaaatgtaccacattttttgtatccattcctctgttgagggacatctgggttctttccagcctccagccctttcttaatcactggactatctctccaatccttccttattgacatatgtttaaaatgtaaagtatttttgttatgtgtgtatgcaaatgaatgtgctacaaaaaggatgtggacaacattgaagaattggttctttacccacccaaggatcaatcccaggctgtcattgactgggcttgctggccacttagtaaaaaaaaatattacatttggtaggaaggctggctatcctcggtctaatgaacttcctgacccaaccatcccagtgatatattatagacatacatcaccatgtctgacattgatagttggattattttttttaattttgaaataagttataacacattaagtttaacaatactataacgttcacattttcttttccaccagtttcccccaagtaagttagccttagacataatcaaaaccaggagattgacattattatattaccaagcaaagacggatgctaggtggttcacgctggtttcttgcacacacttttctgatgtattttaaacatcagatgtactgattcctgtacccaccactaccatctggaaatagcactacgaaatgtccctaaggacactcttgttcacaattgtaccttccctttcaccaccagacatggcaactcttccacacagttgtcacttacagagtcttacatcaatgaaatctggggtgaatgtgccatccaaagaaacacaggaaccagagttgggttccaggaacccatgagaaaaagcttgggtagtagcatacactggtagttccagccctgggaagacagaaacggtgaaccactgagatttgtagcaagccaacgctaccttttctcacatttagccctacttggtgagcccaggccaatgagagaatctgtctcaagaagcaaggtgcgcgacatgtgaggaagaatactcaaggtctcctctggtctccacatacacacatgtacatacttatgtacacccacacataaatttgctcctccctttggacacatgtccaggagtgtttagaaactggatcacataccatgtaacctccagagactggcttttttctcattgatgtgaatgtagcatagtttaggcatcctcacgctgaagggcttttggatcatttttaattgaagctatttacaaataacactgcaatgaccacttaagaacagtatcgacatggatttttatttctttgacaaatatccaggagcaggatcgctgggagtattagttacttttataacacaccgcaacaaaatcagcttttgggagggtttatatggggcttataaaggaatgagtccagcaccatcatggtggggaagcatgtctggaggcaggaatggtggctaaacagcagctgagagctcatgtcttgaacaataaacaagaagcagagaggctaaatttgaaatggcacaaatcttgaggtcttaaagcccatccctagtgatgtattcctccagcaaggtcacacctactaagcctccccatacacccatcagttagggaccaagtatttaactgcccagaccatgggggatatctcattcaaaccactacactggataaaggtaagcttaatttaaatgagaaatgcccccgacaggctcaggcattgcacacttggtctccaattgtgggcactatttggggaggtttgggaggtatggtcggtcctgccataggaagtatgtcactgggggagggcttcgagaatatataaccccgctccacttaccatttgctccctctctactgcttgtttgtggttggagatgcagtcagtctcttggttccctgctcctgccaccatgcctgtcccttgcagacggactcttctccttccagacccaaaagctaaaaataaactcttaattccataagttgttcttgtcatgatattttgtcacaacaacaggacaattacacccctctctccccaaggttatataaatagtaaggacctctgtggagacaggattatttccagtctgttgtgttgtctgcaaatcatgtagagagctcttgggatacacccttcatgagtcatcacctatactcagggtttttgagtaatgcagtattgtacttgtattgtccagtgttcctgtcagtaagttctcacccataattctgtaagtaatccagataaacacattggcttttgaatggacactttggtaggatagtttctttagtctgtcattggtgctttatctgggctgagtagatgtttgcatgaagtctacactctttgttttttgtttgtttgtttgtttgtttcaagacaaggtttctatgtatagccctggctgttctggaactcactttatagaccaggctggcctcgaactcagaaatccacttgcctctgcctcccgagtgttgggattaaaggtgtacgaacaccacgcctggctgaagtctacactcttataaaaaaaatagtcctgttctcacttcatttctgttgctgtgataaaacaccttggccaaacagaacttggggaagggaaggggttcattatggcttacagttccaggttctggacagtcgatgagaaggcaagcttagtcacctcacacgcatagtaaaggacagagaaaaatgaatggatgcctgctgcctgctgcctgcttgctgactgcctgcttctgtttatcccctgccataaaatagttgagaaccttctgcatagagaatgttgctgcccacactgggctgggtcctcctacatcaatcaacaatcaagacagtctcccacagacatactcacaggatctaggcaatttctcaaccgagactctcttctcaggtgattctgggttgtgacaagttgacagttaaggctaaccatcacagtgtatattagaacttatttgttctaataaacttagtaattcccatgggtcattagctctacctggtaggaactatctttgtacactttgttaatacaaattgactacttgttttaatacctcatataaaatgacagctgtggcatttgtctttctatgatagagttatttcacttagcatgtctttaaagtttatctgtgttctcatgtattacagaaatattcataatgttaaggctgaataattttcatgtgcatgtgtacagacacatgcacatactttctttgctcatttgttatgagggatcatacaggttgtttccttaagttggctactgtgaatagagctaccatgaagatggggtgaaaatatctgtttgtgatatttagaatggctcttttgggtaaaattcttttgaatactagatcatgtaagagtccaatttttaattttgaaaaaatatttatttttattttgtgtgtatgggtgctttgctagcatgcatgtataccacacgtgtacagtacctacctgcagaggtcagaagagggtgttagatcccctagaactggtgttacaggctgttacgagctgctttatggtgctggcaaccaaacgtaggtcctctagaagttcagacagtgctcttagccactgagccatcatcttctggatgtatttttgagaacctactatactcttctgacatggcatatcattttacattctgtcagttgttcaaaaagcttggagtttccccatatactcattaatactggtttatcaccatcatcatcatcatcaacaacaacaacaacaacaactttattttataatggtaattgtgacagatgtaaagcaatatttcatgttggttttgatttgcatctttcagatgtcagtgactatatcctcgtgggtcactcatatgacttcactgtagaaatactttaattatttaaccccctattcctcccctctccactttttatagtaatgagggttgaacccagggcctcatacatgccaggcaagaacattacccctgagttgtatcagtcagccctactcaatttttcagcctcttttaacatcaagatagtaaatgtgttgctgtttggaaagtttggggattttattacatcttgggagttccttatatactttgataattaaccccttagtggctggatggtttgtaatatttttatcctttttcctgagttgtctcttttttctgttaatgttttctttccttatgtgatgctatattggtctgaatgagaagtgttccctgcaggcctgagcatttgaatgcttggttcctgtcttagtcagggtttctattcctgcacaaacaccaagaagcaagttggggaggaaagggtttattcagcttacacttccacactgctgttcaccaaaggaagtcaggactggaattcaagcaggtcaggaagcaggagcttatgcagaggccatggaggcatgttacttactggcttgcttctcctggcttgctcagcctgctctcttatagaacccaagactaccagcccagagatggttccacccacaaggggcttttccgccttgatcactaattgagaaaatgccccacagctggatctcatggaggcacttccccgattgaagctcctttctctgtgataactccagcctgtgtcaagttgacacacaaaaccagccagtacagttcccagttggtggtgttttggggggaggtttggataccacaagcttgttggagaaaatgtatcactgggagtaaactctgagaacagatagtttcccacatgtctagttcatacctgctgctttgtgcctgtggtccgagacatggctctcagatctctgctcctttcaccatgcccgattgctgccgtacctcacaccatcatggacacttatccctctggaaatcatgaggcaaataaaatcttcttcctataaatcgccttgtactcggtattttatcacagcaatagaaacggaactatgtagatggggtccctgttgtctacttttgcgtctgttgcctgtgcatttggtgatgtatctatgaaatcgtagccaagaataaaggcaaagctctttccccatctgttttcttctgaagttttatcatctggggcatatctttaagtctctaattcatttagagtttgcttctgggcataactctttttctcaatatggcagtgttggggactgaacccacagtcttgtgcatccctggtgagtactacttcatttaatgtttagagaagccccgactattccctaacctgactctccttctcagtcaagtttttattgatggacgcagctccagtttgtatcagagaatgaaggttagcacagtatctgttttcatggaacttctggtaaaatatacatccataggccaatatacatgaaaaacaactacacccctgactgccttcaccaacctattgctggtattttatttgtgatagttggaggtagggtgtgtgcctgccactgcatatgcgtagaggccaaaggacagctttgtgagtagttctctcttacctttcttagcttctaggaagtgagctaaggtctgagggcttgtgtacaagtattttatttgctgacgcacctcaccacccttcattaccaacatttcaatgttccccagctgtatattaaagggcccaagaagtctataatgcagtaacctgcttaacatcactgacacagaacttattaaatttgcatgacaatgtaaaacatacggattagtatataatttaatttaaagaaatcttaatttgcttgcttttataaatgcaatttgttaaattgcctcatggaacagctattttcttcagaggcaaataaaagagacactaatattggtaatcctgcttcacccaggaagagcactggtcctagtcaggagtccagcaccgccgtcactgttgggtatgtctttacatttaagtcaagttcagagttcagagtaagagactatcccagatgctagggtggctttgagggttctgagaacccaaaggtcacgtgaaagatatggttactattgtcaggctgattctaatcagaaatcagagtctggagatggagcagataccattgagaagcagttaggaggtggtaatgtggcactgacaacccagccaaggctcaggtagcggtggacatgcgcatttgctttctcttgtgtttatcgggcaacaagcctgggtgaactggaaagcggatgcggtctgaaggtctgcatgaaaccacagatgtcgatccgtggggggcagactccgggggcatgtgtctcaggggtatagcacttggaggtggcaaggactaatttcaaggtctcacactttaaaagcctaaagtccaagcataggtgggagcccagcctagactcagagcgcagacgcggacagagagcatgctaggagcctctgttggacagtcaaacatgaccgagtaagaccgaaactccatagagacagactgagggaagggagaggttaaagacagggaacctgggctctaagatctccctgtaacagctctccctttgtaagattggatcgaatccctagggtaaggggcacagctgagcttccaggtgagacaagagtagggagaagaaccatcaggtaagacaatatagttagagccccaaaccaatgaaccaactaaccaaccaaccaaccaaacaaacaaataacccaaagaccaaaaaaaaacccctaaaaatcaaaacccaaaccaaaaaacctcaaaacacaaaacaaaacaaaaagacccatgagccacaggaggaacacagttctgtgaaccctgggctcaaacaagggtatggatagaaattaaatgttatatggatggaaggggacctggagaaatcccagtgttttctcttggatgaagactcttgatccctgaaactaagtctcacaagcccagatgaagttgtgagtttaaatcttgtcaagtgtgaaactagagccaacagtcaaatgcctccctccaccagctaaaccagtccattttaacctgtggattaaattgtggtttaattttaggccagaaaaaaatttttacttgccataaatttaagtgctttagatacccatgacataaagactggagcattatgtaaaagggaggcacattagaggtcatttaatgacttgtgccacttcagagctttctatcacatagtccacagcaattcaaagtcatgacccctagaactaaaaacattacccatcagcctttgaactctgaaaccggccaagtgtaataagcccagagcaaagtacagactttccagtgactgagcacaggcagtgactagaccagatcggccatagtgagaccacacactggccctactcagcgggcattcactcagcctagattccattttggttgctgctcacctagtctcaaaaagtctcagctaagtgatgtgacagccctttgtgctaggacatgatctgttctaaatatctttccacaggtgtgctgcaaatcaccgtcaacctgataagaacaatccctacaataaagtgagttatttataccaacatcctcccatgttgttgaaccaatgaagcaaatgtggaagaataatgtttggctcctttctgttttgaaaacattttctgggaaagcaggtgtttgcagactaaatagatatgcatgccatgggtgatagatagtcttagatgtcaggtcagttcttcatcggggacagatctttggaggacactgtaatattggtcatgacagaatagattctgatagaagttggtgtctaaaatgaaaatggcttggagaccacaggtgatcggggagttcctcatggctgttacttataggaagaattcttccctcctataagccctgctccatccagctcccaaagatcaaccagtattaagactgacgttgtttaaagcaccactatctgtccctgtatctactccaacgcattgagccagctatatagcactttttttccgttccccaataaccctaaatttcttctacttcttgttggagatgtttcctttgccccagatgtctttcatccatccactaagtacttccatcccttcctgtactagctaattctttcctcccctccaagactcatcacaccaccgtgccctccaggatggcttctctcagtcctcactcatggactgagaggtgctcccacctcacttgcctggtaggtgctcccacctcacctctgcatgccaggagctaagaaaaggaagttagaacattactagagattcgcttggaaggaaggcaggaactgagatggaaagatggggggggggggaatgataaaccatatggagccacatgaaacctggggttgtgtgcagtaaggggtgaaaagggatctggctaactgggtgttctcaacgcaaggaaagttcataagacaaacccaaatgagaccattaatactgccaggtacagggcaatgtctacaacaacgacgatacagaataacccgtggcctggagaggtggctgggtacatagagtgtttgctaagcaaacaggaggactggaaaccagaactttaggatcatatacattccagatgagcctggcagcccaccaataataccaatactaattaggcagaggcaaggggagctccagggcaaggtggcttgctgaactagcaaaatcagcgtgctccagattcagctggaaaccctgtttcagtgaataagatggaggcaataagacatccagtgccaatctctctttcccacatccacatttgcttggtcacacaggagtatccacatccatccacatgcatgcatacacagccccacacgcatacacatgtgggagaaaaggaaaaaggaaagaataaagtaggtagacatgacgtcgagaagcaatttaagcagggtggatgtgttttctgtccatcccttgtgtgtttgtttctctttcctaagctccactgttcattaggggaaagttcaactcacataaacttttcatgtcttcttcagatatcctcaccttgagatgatgtagtgagtagggtcttgtgcacaaatccctcagggtttggagtggggtatgggtgtcaaagggcacaggtgaaacaaacctggctgtgcactgattcttgtagggtctagggttttatggggtgcttctacttttggggggacttgacaattattcacaacaaaactacaaaacagcgcatcaggaactatgggttcttctcaagtggagggcattacatattaactgaatgcgtacacatgcctttaagatgggatatgcatatgcactgtctaagataccccgagaaggcactgggtatttcagatgctgaacacagattttcctaagctcttgccttcaggccaaattctgcttttcctggactatggcactgtgcagagaaaaattatttgagggcaaggtggtgagaagtcttaaaggccccatagccgaggatggggtagggctgtctcttctcctgtgatcactgaaggcctcttatattcaacagacaccaaatctgagaggtcctaccatggccaaggccatatcccctttcttatgttcagagatggaaaaggaggataatcaaagtgcttaactcacagggtcattagtaccatgaatgtgttaaggtttagtccagtgagttgttagcatcgggcatctgtgctttactatcagagttagtgtttgcgttggagttagtgttatgggtcaatagttaccagttagtcagacacacactatgatggataggttgtttatagacagagagaagacatggttttctgaatataagacggggaaggagtaccagggctaggaatgagcagagaaactatttgaggatgcagctgtgtataatttaggcagggtgtgtaggggaggggagagatgtgaaccaggaagcaaggcagggctggatggatgatggtgggcctggcatggggcagcaaagttgagacttgaagcaggaggccccgaggagccagggagtgacctggtccagggaggggcgagatgaaaacatacttcaggaggattaggctggcatgagatataaagtgtctcggttttgggcaggttcagaccaagggtcgagaagtccctacagagctggaaatttctagacttcctccagcctcaggctccaagctacatttttgccaggctgagtgggaatcctggagttttccatgggacccaacaattcatctttgtgtcttctgttaccctcagctttgtttttgtgttgcgtaacatttccaggtctcaatatcccaagcaagctggagttttcagaggttaaactctagaacctacccagcctgggtggcatctctggaagcaaaaagagacaccccccttttgaccagagatccttgtagacaaatggccttagctgaccctggctgttctttggttcatataacaatactcctctcctctctctagtccttctcccaacctgtttagacacaagacttacataaaccttctccactcccctctgcttcttcaggtggaaccttgaagaaaaaaaaagttgttactaggccaaggagcaaggtttggaaagacacgatgtgctgccaaatccaggaaagcaagttaatgagaaggtgagactctgtccacccactttctttcattggcggaatttttaggtaacaaacatagctccaggcaggtgtctgtgccccactcccatgctgagcaggagctggacccgagctgcaggtcccactcagccattcagtggcttcatctctgcaccatctccagacccctatgtccaattgcacagcagtgatccaggtccttccctctcgaagtccttttgagctctagctttccaggatgcccttctacgggtcagtgtgttggtctggatgagtcctgggtctgaccagaactactctgaaagggaagataaagaaagagccttagaagaactagctgtcctaacaacaggagaccccgtactcacatactaatgtgcactcatgagctcatgtggaagtatacatataagcaacactggtgagcacatgcacacacacacacacacacacacacacacacacacacacacacacacagcatgcatgcatgcacgtaaaataaagcttataaaacaaaacaaaacaacaccaagaagcaagcaagcaagcaagacctagggtttttatacatctgttgtgggattgttgttgttggtcttattgtgttttgcatttttggtttgagacaggttctcactatggaaccctggctgacctggggactgcctgcctatgcctcccagagtgctgggatcaaaggtgtgtgccacccatgcccagctgctgtggattttataggtcgttgatggctgggttttggttatgagtttaacactgctgttgaatgcagagagccttttaaatcgagcatcaatgaggggttgttttgttactgaggggctggacatgggtttgcttaggactgagatttgctttctgttgcctcccttgttctgagcgcaattgcttagctagatgtcgatggcctttcaccatgggtttcctgtgagcgttacaagctgagattggcaggtgcattgaggaggtgggcaaggggaggggcgacagcacaatgctgtttccctattggtgctaagtgctgttcctgtttaataagtgcagttttgaactggaagagaggaggtgtgaaaacaccacacgagtcccctaaaatagcctcttaacaaccaaatcaggagtagaatctggtctccgttcaggaaacagggtgcttggatgtccactcccctggggctccttagcccgtctttccccttaggttcaaaggttcttcataacctttgggtccattgactttacttctgataatatcaatgacctggggacatccaccttacatatgaaggacccctgtcggcatgagtagttgtctattaactgtcaccatgtagtcagcttctctggcagagatgattacaatctaagtctagaatgctgggaccctttaatacagtttctcatattgtggtgacccctaatcttttttttttttttccgagacagggtttctctgtatagccctggctgtcctggaactcactttgtagaccaggctggcctcgaactcagaaatctgcctgcctctgcctctttgttgttacttcatacctgtaattgtgctactgttatgaatcataatgtaaatatgtgtgtttttgatagtcttagcccctatgaaagggttccttgaaccccccaaaggggtcgtgccccacaggttgagaaccagttctctaaagagccatttatgaccccctctttggctatcaggcttctaaaagaatttccctaggaatctccacatgggagaagaaatagccaaaaccccagggacatccagaggaagacctaatgttttgtgaagaattttgcaacttattagatgacttcatagagagttggcgctgagacggccgtgggcagaggccacaccttgtctgaactattcaactatgcatatcttttctttttttatgtaccctcacgtatggaatttgaaatcaaacttggatgtagtggtcactgtatttcctttgtccctctttccattgtggccactttgaataaatctccattttaatttggctcttttatttggcttgttcaggataggtggccaaacctggctagttgggggctcaggttgaaaccctaatctggtaatagtaacatatgtcctgagtctggacctgtacagccatgctcagtaatgaagaacaagcagcatattggatctctcctaaggggtgaatttcacccctgctaaataagcaataattgatcaaacaaggactggctgcatgctttttatgctcctcagtattcgggggcagcctcctctttttcactactccaaattctcattctgacttgagcttagagttgtgtttactccagactcacgcggtttcccttgattattattgtgtgcctctccctctgaagctgaagaaatagctgatccttacgtgcttgtggagtaagcaaagaagtcacatgactggatcagtacaaaaatgtattccgctttgctgtagtccagtgaatttgaagccatggatattttcccttttaaatgtacagttcatgtttagagaaaggaacgcaacgatgtatcaattgcttgtatacttactgtcaaagtagcagaagttaacatttaggctcagtacttttgaatttccttctttcttgaagaaatggagcattacattcatttccatctctactgagaaaaccagggctgagtggccagccatgtgcttgctgtctaaaatgcactgatggggactggagagatggctccatggtaaagtgtttgttctgcaagtatgagatcttctgtctagacatccagaacaacatctaaaaatatctagatgtgatggtgccttcctgtaaccccagcaggggtaggaagggaacaagtggatccttggggctgtctgatcagccatttcaaagaatcagtgagatccatcatgaatgagagaacctgcctcaggaagtaaagggagaggctggagcaatagctcatggttaaaagcactggctggttccagctctagcagcaatctacacggtggttcacaagcctctgtaaccctagacctaggatgtaatgtgcccttccagtctccaaggatactgcatgcatgcatggtgcacagacacacatgcaagcaaatacccaggcacaaattaataataatgatgatgatgatgatgatgtagatagatagatgatagatgatagatatgtgataaatagataatatagatgacagagataaatagataataggtgatagatagatacctagatggatagatagagataatatagttagatagatatagctagatatagtatagatagataaatagatagagatagataaatagatagagatagataaatagatatagtattgttcaatagagatagataatagatagatagatagatagatagatagatagatagaatagtatagtatagtatagtatagtatagtatagtatagtatagtatagtatagctagctagctagatatgagtgtggtagcacatctgggaggcagaaaaggtctgcaagtttgaaggcagcctggattacaaagcaaattccaaggctacatagtgagacattatcttttaaaagtacatatataaagtaaagcagaagcagaaataaggaaggcactgcccgttggcttttgtccacatacacgtacacactcttactcacatgtgcacacatataaccagggccatacagaatacacacacacaaagtctaagaatctagggccaacgagatgtctcactgggtaagggcacttgctgctgagcttgatgacctgaggttaagccttgagaccagctctcacagattttcctctcatctctacgtgcatgcaagtgtgtgtgcgcgcacgcaggagtgtgcatgagaccagtagaggggtctttttgtccattgtcatcactgtcttcaaatcagccatatcaggcacttggaacttgtccctttcatatacttccttagaaatccctccgttcaatgtcacttttctcatttggactggttaaacaattccctggactgttctctagaaagacagatgtgtgaataattaactcaacctcattaatcagttgctaccccggtttctaagcttcaaagctgagttacttgcccttagagcatagaattggtttataaatggtgtatgcattcatgtatgctaaaggaaattatacgttttatagaactgagaatatgtaaagtatataaaatgtactgtgaaaaaaattaagaagatagagacgactttttaagcaaattcaaagagcttaaagtcttattgtagatagtgttttaaatttttttcacttataattattgtgtttgtgtgtgactgtgtgtgtgtgcatgtgtgtatctgttcatgtgcatgttccacagtgtgcatatggaggtcagagggcaaactttcagagttcacgttccactgtgtactcagaggctcaaattcaggtagtcaggcgtgcacagcaagcatctttctacaccgagggatcttgcaagcccaagtgacatcatatcgatactcttaaaagtcattgccttcaagggcaaaggtgatgtcataaaaaagctcgtgcttaagtcagcttaagtcagagagcagcctgcagagttctgtgctgctgacaccgtgctcattgcactaagcctggaactatgggaagctcacagataaccaatacacagacagttccctgaagactgtagtcaaggagacgggtgcacacagctaaacagaccacaagccagcgaagcagatgctgtgacagtcacttaaaggacatgctgtgggtgagactagggagctgggagtaggtgccaatacagcaaaattccttgtgcttaccaaatggtccatcctcactgtcagatggcaggggcatgcaggacacagtggtggtctttgacttggttatgaaggatgaaaagacttcaacaggaagacaaattggggatgaagatgtaggcagtggagggaaaggagaagcagtctaactggggctgaagagataaccagaggacacagtgttggatattttcactgagattaatcaacagttcagtctttggtccatcagcccctcctccacacacacatcccccactcgtttttttgaggtatggttcacgtgttccaggctagcctcaaactcaccaagtggttagctgaagatgaccttgaactttagactctcctgcctgtacttccccagggctgggatgacaagtgtgcactgccctgcctcaggtgtgcactgccacgcctggcttgtgctgttactagagatggaacccaaggcttctggtgttctgggcaagcacagcctggctcacatccccagccctggtccactcttgtctctttccacagtgatctatctagtcttggtcccagcaccttgctcagagggagtggtcaccgatgacctctccgctgtttacctggatggaccctccttagtccctcattccttggcctcttgctgatgtcacttgtcacgtcaaccttgatgtcgatggccacactgacatttgggtcccttgtggtcttcatctgtaacatcctgtccaccgctgtattctctttgttttgttttgttttgttttgtattttcgagacagggtttctctgtgtagccctgcctgtcctggaactcactctgtagaccaggctggcctcgaactcagaaatccgcctgcctctgcctcccaagtgctgggattaaagacgtgcgccaccactcacggcaatattctcttttatctatgttcagatgccttttctctgtcagttcttcctcatcttacatctttatgagcatgtctcctgcagtcttaaggacatgccctctcctacaccatgcctgaattgttcatatctaactttcaggtctcatcttaattattactcaccttaggaacagtttccccaaactttgcatctgtccagtaatgagcctagagataaaactttatcagagataaatgcctgagtacccagctgtcttcctagattagcccatgccattctttagtttctttttttgcataacccgattataaatgtaaaagtcatgtttaccataatattcccagcacttaacacaggctaatcaatatcaagttcttaataaatattcaatgagtaaatatgttattcaggcaacatcaagaatgctgggttgaataagtagggttatataggaagaaacaagagaagaaataggctggatgaagaactttagctttccacttcaaacatttaaggctattctacagataaaactgctatttaaagttgtggtccagtcttcctctagtaacatgctttgttagctggtgtagtgtaaccaattagccagtttagtcaagggttagcagggtagactacaccacaactgtaagagcagcaagacagaaggactgaacagggatggtgcccaagagaatgctgggagttgatagcgaggcaaggccccattcggcatccttttctgccctgttatcattcactaggagaaaagagtgcctaaggaaagccagacttagaaggaagagaggcagagagctcatttcctgatgcagaatcagccggcaggatattagtctatagctcaggggctccctgagcaggagctgtggatttgagagatatttgggaagaactattagatgaagatgtgagggttgtcaaggaaagcagacaaagggaagcgagtcaagagctaggcatgtgtatgaactcaaatagcaacaacaacaacaacagcaacaaatgccatgtatacatggaagagctcgtggccgaaatgacaaaggaaacaaatgttttaaactaaattaaagaaatgatcacgtttagatattgtgcttaaaatcttcaggaggtgaaaggtgatctggaagctgacaccgagcaggggcaaaaagagagcatgtcacagttaggtttagtgggtagaaggtaacatggggatgatcagagaaccactgaagtgggggaggggtggtgatatctttgttcttcagacacagaagagcagaaacaaggactcaggcatgcgtcgtgacagggttagaggcttggttaggtagaaagttaggtttccatgtgtccggggagcggggaggagaagaatgtgttcagggcaaagatccaatgtataaacttttatggccaacagaatgagggctctcagctacagaggaaacacttaatccgcctgtaaatttcagtccgtcatactaacctgacatggcagctggcgtcatcgggacatgagcaatggttccaagcagagttgattgtgcttcctcactctaattattaaccagtcactgtgttagctcattcacgttgagaagcctcccgcctcactacccatctgtatggagacttcttttctacgaaagaagtatgctcattccaaataacatcaagtgtccaaatcattagtttttactctttgttttcatatgctatgggttaagtgcagagctattaaaatacaaaaaaaaaaaaaaaaaaaatctggaatgagccctgacaactgacttgattccaatcttatctgccattttctggctacatcattgggagacttacttaacctctcttaggtcaaactacattattggatgtttcagcccattctaattttttttcttttctcagccttttcaatgtgtatttactacttgaacgtttttcatttaaaaaacaaacaaaaaaaattgaaaaaactcccagaacatctgctatgtgtcagctactgaaggaacacaatgtttaagacctaggttcctctcatgagtcctaagcttgctttagtaggcagtgacagaaggacaaactggtccatccatctagataaacttcggaaagtgaccgtgtccatgggaagtcctccttagacactgtgacccttgagttcagcctcagagaatggatccaagttaattgtaggtgtggaaggttgtgttttgacacaggggacaggcaagtgacaagaaggcactgagttcaagggcacagtatattctaagtgtcagttgccagtggctgaacatagaggagggaaagaggttagagaagccaagttcaaagctcagactatgcatacagtataaggttaaggcactgatcctatagctatgttacctatgaatgagtggtcgttcttgggcaagggacataactcaataggtttttcgcttttccagctgtaaagtggaattgaaaatggtatggcatagcgacctcacatagaagtattcaaaacaatgtctagggcacggttatggttatggaagcctcttgaagggctccagcaagtagagatttgagttgcaggcagaggcaagcgaagagtggattggagagccgtggaaacgggagtggaaagatgttagaaaaaaaatacagcctgcactcaggagagggtatggagatacaggtgaagcagacggctggtgtcagtcttgacagcccatcaggtgaagataggatgagcggtaactaatacccagagttctacttcgaacacatagttttctgtttgtaccctaactacatgcacgcgcgcgcacgcatgcgcgcacgcgcacacacacacacacacacacacacacacacagatacatacacagacagacagacacacataaacagacacacacacacacacacacacagagagagagagagagagagagagagagagaaatgactatatcataggctttggggcagggacaggtgggcctaggtacagagtcctaacttttatcttgctttctctctttctttctttctttctttcttcctttctttctctctctctctctctctctctcccttccttccttccttccttcctccttcctcccttcctttcttctttctttctttcttctttttcttttttcttttttctttttttttcttttctttttgttttttcgtttttttggtttttttgagacagggtttctctgtgtagccctggctgtcctggaactcactctgtagaccaggctggccttaaactcagaaatccgcctgcctctgcctcccaagtgttgggattaaagacgtgcgccaccactgcctggtctacttttattgattttttgatattttccttccctcacaaagaagttgacaaacagcctggcagagctgtgagaactgaatggagactgagtaggaaccgtgccctggatggtgcttggctctcatacctcagatcctcagggaaatgggctggactggggcctagagcactgaatcccctggaaggcccctgttgacaaaatctctccccaaacccgacaaaagcatcacaaactgtgttcttcccagcacctacaggagctacaccttagaacacggatgtttcccaggtgttcttttactgtcctatttctaggaacccgggactcgcacttgtttgaactctagggcgtttaagaagtcactgataaggcagagccagatggaggtgggatgagcaagaactgctactctgaagagagggacaggtgcacagaagactaatggctcagtagacagaaaacccacctctatctacagataagccaggtgacaacattagcctcctcggcagctgtcccctcttctgctgagacctatcgattgacatcctaaatgtcactgtgaaatgttcaagggatactccccacttagcgtagctgctgagccagggaaggcaactgaatgtcttatttgaatgggttgcctggtgctctccagaaaggttccaggctgggacggaaccttcccaagtgaagaaactcacttcacaagcctccagtccccgccctgcaacaagcctgtttgttaacttgaacttgcggtgacacacaccgagttcatttccagtttgcgctccagggcaagtccttgactacacaaagagtgagacagttggggaatttgtggactgtccagttaatcagataaaacccgagagagtcagaaaggcgacttcttggaagatgtcaaagttttactgaaaacagcggaagtgttcgcagctaattggtgctttccttccacacaccccgcactccctaccgccccctccctccccgcctcccatccctgtccagtccccaccccctgaagtttgtctttggtaaaccccagctacttctctcacttgtctctgaggcacaatgggagtcttcatctgaattctagggaagaaaagatatgactccttctagcacgagtgagctggattgtaacagggaacgaattgattgatttttcccccccttcatctcaatgaacacactatgtagccaaaccaaggctgatcaacaacactcaataaaaaaggagattcaaactgaggcccagctgagccctactagacctccacaatgcacgctgtcatctgcttcttacatgtcatcacatttaattatattaatcttcgccataagtaatggaggggattattatgagccttggtctagcaactgggttcaaggtcacttagctaatatgtaactctaaatgttacaagtttctaagccaaggatatgtccttttctcaggccgatgctgtcctgctggccttctaaaatgttagttctctgcctcttgttctgtgcctacctcagtgccccacccccactcctgctccccccccccccattattctgatcacatttacattcccggtctcccattctcctgatcctgtgtgcttacatcagctagaaattatatgcaggacttttaaagagtttttttcatagtattgcctttttgcatatatatatagtgttctttgtttgtttgtttgtttgtttgttttcaaaacagggtttctctgtataatagctttgactgtcctggaacttactacagaccagtctggccttgaactcacagacatcctcctgcctctgcctgacctgtcaagtcctgggattaaagcttgcaccaccacacccagctgcttttatagttttttttttttttaagttgtgtggtgtgcatgttgttgtgttttataaaatagctgtggtataatgtttggggatggggaacatttcagcaggcctctgccaaggcataccccttgaggaatcagtcataccacaggcttagtataaaagggataggggacctggaaaaggggcagaggcagagaaggtgggggacagaggaggacagaaagagagagaggccagctgggaacatgttggggagagatagagagagggaggaagggaaggagaaaagagaagagagagagggggagggagagggaggaggagatgaagaggaagggagggaggagagagagagagagagagagagagagagagagagagagagagagagagagagggagggagggcaagcagtcctttttatacaccaggttggctcacacttggcaagcctcaagctgttgctaggaagctgttggatggagcctaaaggaactgccaatagtgtgtgtacagatgagtttgtgtgtgcgagtctatgtgtaagcatgcagaggccaaagatatcgttctatatgacagggcctctcactgagcttgaagctagtcattttccccaggctggctggccagcaagcttttggaatctgcctgtctctgtcctccaaagatgtggttacagggatacatggtagtgcctggcaatgcctggctttttatgaggatttgaagtcaggtccccctgcttgcatagtaaatgctcttacccactgagccatcacctcagactcatcttattaattgtttcagtgtcgctgtatcgtggacacaaacatatgcatgtatataatagggggagagcagattattctggcatttcgagatcctagcccagtgcaggtgggtggcagtattagcaaaatcactctgatctgatatctgtttattcatgtattcttatctaagtgttggaagaagaaatggcacgagaaagcacagtaacttagttcacagtcacaaagcttggcaactcctagctgggtggtgacacgggctgtacccctatcattcaggaggctcaagcagaaggctcccgagatgggagctagcctgggcgttggagtaaatcccagggtaactttggcttgtgtagtgagttcttgttttgagagactcacgtctggggagccagagcagtagctcagtggttaaatgtactttctgtgaaatcataaagatgggagttcaaatcccagaacctgtgtactgacatactggggaaaacctataaggccagctctggagggaggtggaggcaggaggattgctggagttagttggtgtcttagtcagggtttctattcctgcacaaacatcatgaccaagaagcaagttagggaggaaagggtttattcggcttacacttccatactgctgttcatcaccaaggaagtcaggactggaactcaagcaggtcaggaagcaggagctgatgcagaggccatggaggaatgttctttactggcttgcctcacctggcttgctcagcctgctttcttatagaaccaagactaccagccctgagatggtcccacccacaaggggcctttcccccttgatcactaattgagaaaatgccttacagttggatctcatggaggcatttcctcaactgaagctcctttctctgtgataactccagctgtgtcaagttgacacaaaactagccagtacagttggcttccagcgcagacaggaaaatttgaatcttgattcagaatgagatccgtcctcaaatgaaaagccagaaagtaacagaggaggacactcaatgccctcagtgggcacgcgcacaggtttgtgtatgtgcacagaagatggtatactattaccatacttgtttgtttgtttgtttgtttgtttgtttgagacatggcttctctgtatagctctgggtatgctggaccaggctgacctcaaacttacagagatctgcctgcctctgcttccagagtgttggggttaaaggagtatgccaccaccccctgtggacacagatgtattcacaaattttcaaattgcatctgtttgtttggctagtgcacctggcacagagcgtcctccacatggcatggatgaagacttattccaattggttattgatcaaactaattcatgaaaaagacagctgtctttcacctgcccagacaaggagcaaaaattcatccttatcttatggattgtgcaccttgcacaatccatacaaatattttttataggaataaagatttggttgtaagattcatatattacagaatgaaacagggagatacagctctgacaagattcatccttggggatgctgagatgacccgctgtcccagctcgctgccacatcctgcctcacctgatgctgtttccagagacctgcttccagagcagcgtcaggggtggctgctgattcccatgacatcagttcatccagcctttcagacagatccaccaagacttcagttaagccctgaacattctaagcatacagggactggataacaaatgcgaaaactagctttcttaactctaaccaagttttcttatttccctacacctcccacccccttgaaaaaaattcatcaccccaattcagcaggaagtagttatggagagttgtcatcttgattccttgggtttaggtgtctggctatggttattttaacattattatagatattttaattatttaattattattaaattatagatattttaacatattaagggatactttggaaatgatcataattttagacagggaggaaactagagaggttagacttggagattctgtctttttttttttctttcctttgctctagccttactttcttaggtaaaaggaagggagctgaaatgaaaatggggactagagtaatataggaaattagagatgtgagatggattattcaatttactcttaaacaaaacattttatagttataatctttcattggtagaaatctttacattttgatgcagaactaaagttatattttcttacattggtacagaatttatatatcgatacaggtttaaggttttcactggtataaatctttgtatattgatataaaatttaaaattaattctgttactcttagacaggcattgtgcctatacaactcatttatacaatacaaggcttagacccagtccttctaataggtactgtcacaaatggtttaagatgattaagtgatgcaagttaatggtcagatagtaaactcatgctcatattagattctgatttaattacaataaagtgttttcaagattatcacgtaggaaataactaagagtaatcaatgtttaacaattcaattatattacatatagatagatggtcttcaaaaacatcagaggtccacaaaatatggcatttaaaatcatttcactattaataggtcttttgactaggagacatgtctgctcctaacagtacccccatctcactgcaaagaaggtactgagtatcaatacctcccaattggagttgctttgattgcgatgagctagctgctggtaagaaatagcctaatttaattctacagacaattactgtccagaaaggacaaatggatgcaggacagttgactgctaagctctgccaaaacagagtaagctagtcctttatatttcctgcttcatttatggtctatcagatcgttctggaccagaagtctgaagacaggtgctccaacattataaggaatattgaggactgtccaggcagtcagttgttcctacaaattgtattaagttttagaagctatgtctttgtgctttctacatattctgataattttaaattccttctcagatctctgatggaattgaaaaatagttatagtctcataattgaacttaagttatttagcactaaagaagatgttctagatttgaaaggatggttttctgagggtattgcaagttaaaatcaagcataattgaggtacagatttgtaaattctgtaagttaagatagataatagagtactttatctaaattgtcagatatgatgtactggatgttctaagtgtatatcataccttacaatttacatacttgttataactgtgttcaatgtatatttgggagaaaagagtttttaattggacaaaaggggggaaatgtagctgtctaatgctaattatgtttcctcataactatttgcatgagagggtctgcacatagcttctgggaaccttcccacagttaattctgattggtaaataaagttcccagcagccaatctctggggagaagaaaaagaggtgggtggggcttaggtttcccaggtgtgggacctctgggaagagagaaggaagagagactcaatgcctgaaaggtagtataggacaaagaggcagagccaccctgtaaaggggccaggagagagtggcccagatggctgctcaattgggccaggagaggccaagatggaacatagaaattggtaagtagtaacttggaattattggcgggaggtagagtctagcagtatggaggctaggcagatgcccagctattgtgctgcttaagtcatattaaaatataaaggctgtgtgtgagtttttcattagagatcataaaccattgaggtaggaagtaatgctgtgctgggatttattaaaacattaatactacacttgtggcaatcacaggacagacaacttgtaggaatggattttctccttccaccatgtgggtctagggaattgaatttaggtagtttacagccttggtggcaagcatgttcaagccagccccaatttaatgattttaattaaagttgttgtcctctgaggcacaaaaaaaccccaaagggttcaacacaatcaggattcctgctggcctctcatctacagcttgggccagaagccttgctctgttttgcatttggaatattttatctcagtctctgtaagtcaggcccagggatgggtatagtcagtacacatgaatttggtctgcataactggaaatgtgattatagcttctcagctgttccaaaggagaagcaccatcatatcccattctgcctttgtgtgaaaaactcctcaaaaatacatattagtttgtatctcatatatatgtatacatatacacatgtatgtatgtatatatgcatgtatgtatgtatatatgcatgtatgtatgtatatatgcatgtatatatgtatatatgatgtatatataatgtatatatgatgtatatatatcacagacacatataatttaggtcactttttgtccctatgttttatttctttcaaaacctactgctgcgccttacacagtgttttgagaccatcttctttcttatcttttttttctcacataatatatcctaattacaatctccactccttctagtcctgctagttcctcccctcctatccagagccacctttctgtctctaattagaaaacaagcttctattatatagattataataagacaaaacaacacctaacacaactgaataggacaaacaaaaaggcagaaagaaaagagaagtcacaagaaatagatccacctgttcacacactgaggaattccatataaactctaagctggaaaccataatataatgtgcgaaggacctttagggtaaagagagagaataaaactgcataaataaaataaagtaaaaataataataaaggaaaatccctgacacagcacagtaagacagggaagctccaaagactctgttgagttcattctctgctgaccatctagttctggacatgtaacctacccttaagagtcgtttgtttccacagcaagactgtcttagaggaaactaaattttcatttggaaatggttatcaactggaattgcttctgggttaggcctaggggcttgtgtctacatcttctctcagctctagggtccaatcttgtccagacctgtgcaggtccatgcatgctgcctcagtctctgagttcatatgtgtatctatcggcccttgttttcttggtgtgccccatcccttcttgctcttgtattttgcctccttttccctgagccccaaaggaagggatctgatggagatagcccatttagggcagagtgctttaaggtctctcatttcttacaaatatctgtctgtgagtctctgtgttcccatctgctaagggaggaagcttctctgatgatggctgacaagacgccaatcaatgagcatgtcatcaggggtcattttatcgttacatttttgtttgcttaaaaatagtaatatttggttctaccctaggttcctgaactagcttgtctcaggttcttggttacccaagcagtgtcaggtttcatctaatggagaggaccttaaatcaaatcagatattagttggttactaccataagatttgtgacaccattgccctagtgtattttgcaggcagggcatcattgtagatcaaagagtttgtggctgggttggggtttacctctctcctttggtagtgtgccttcccataccaagaactctggtagataaaggtgaaggctctatgtaggcaccagctcaatttctccacgttcaatgggttgtgtaggtgttgtcttcagcaatttttagggtcacttatatatactatcatatcatctgcaaataaacacactttttcttctttgtttccaatttgtatcccattgattttctttagatgtcttattgctctagctagaacttcaagtgctatattgaaaaggtatggagagagtagacaaccttgttttgttactgctttttagtggaattgctttgggtttctttccatttaagttgatgtggtcttgctgtaagctacctttattatgttgatttatccctaattattccaggacttttattatgaaggagtgttgggttttaacaaatgccttttctgcttctaatgagatgacatgtggttttgtctttcagtctgttaatacgatggattacatttactgattttcatatccctgcatctctgagatggtgcctacttgatcacagtgtattatctttttgatgtgctcttggattcatttgcaagtattttattgacaatttttgcatctatgttctgtttgaatttggtctgtagttttctttccttgttgagtctttatgtggtttgagtatcagggtcactgtgacctcataaaacaaattgggcagtgtcccttctatttctactttgtagaataatttgaggaatattggcattaactcttctttgaaagtctggtagaattcttcactaaaaccatctggccctgggatattttttttttttttttttttttttttggttaggagacttttaatgactgcttctatttcactaggggctataggtctctttaaattacttagctggtcttgattcaactatcataagtggtatgtatagagaaatctatgtgagctgaagagatggctcagcagttaagagtttgctgttcctctgtaagacctgaatttggttcttagaacccagattgggtaactgatagctgtctgcaactgcagttccaagagatataatactctctcttctagacactggacatggcacacacacacacacacaaagttgaatgcaaattaaatggtagataacggtatgtgcacttcagagtttgtggtaagtgacagttgatttacttgatgcaacacagagtcgtctggaaagcaaatcttgtgcaaggatcgcctaggttaggctggctatgggcaaggctgtggggaattgtattagttggttacttgtggtaagacctatcctgattatgggtggcaccacctcatagtctcagtcctgggctgactgaaaaggagtaagctgagccctggcatgtaagtattaattcttggctctctgctcttgactatggatatgatctgactatctgtgttaagttcctgctgtccccactgcccaggagtgatggccctagcctgcaactgtgagccacagaaatcccttttctcttaagttgcttttatttcggggttgggtggtgggcggtgagaccgaggttttgtttttgtttttgtttttgtttttgttttgtgtgtgtgtgtgtgtgtgtgtgtgtgtgtgtgtgtgtgtgtgtgtgtgtccgtgtgtgtgtcctggctttcctagaactcattctgtagaccaggctgacctcaaattcagagatgggttcctttgaggcaagcaacttctgaaggctaggaaggctcaagcacattggctcctgggtccacagtgctcagcatctgtatttcatgaacagttcctgggtcctctgccagggctgtaagaagcacggtgtctgcttaatacaactgcagccaaagaagacagaggtgttggtgcaaaaacacagctctcacatcaaagcaggtaatagtttattctgaagccaaatatgagtcccaatggcctagtaatacagatttaagttacccagcattctgtgtccaatgtgctaagatttggtaaagtttttatggaagcagaagaagtttattacaaatccgggtacttttcaaacacattggtggaggcatcgggtaggtggatcacagcaaagcaggaacaactttacttgaggctcagatgctgacagtgtttcacagcccattggttggccggaaactaagagttcgcacattctacggaatttacctaatggcacatggaagggcaataaatggctgtttaggatcctaaagatgccccaagataatttggctctagacttgcaacattctaacccctctacatcattgacattctaatcagttccgtcagcctttccagggctggggggtaggggaggaaggcaaggctatttgaggaatagcttcactacttgaacaccacacattcagggctgcaaaggacacacaaggctctggtctgtggttactagacctctcatcaattcatgaggttgtagctatttcgaactctggaccatcttgtagaggaatgtgaatgaggctgaatttccgacatgcctttggacagatgttcgtgatgctaactctagtttttgtaagatagttattctcttctgtgaagtgatgaagaatttgacacagttttaaagaatctccgtctctctgactccgtctctgtctcaatctctctctctctctcttcaaattagaggtttggtaatttaggcacagggctgctatatgactctttgatagcctcacaggcatgtgtacttagtgtgatgctcagcactttgaaggaaggaaggagggaggaagggagggagggaggagagagaaaggtgaaaggagggatgaaggagggaggaaagaggaaaggaggaagcaaggaactcagttataggccaaagagttttcaggtttatagacacatagatggttgcagctgtagcctggcagtctacataaaggacacataaagacattctcttggccacaggttgctaaggctgggtaggaagtctgtagaaggaagccagaagtcagtaagtcacagattaaacattgagcaaaggaccacatcattagtcactcaatgctagtgtttatttgtctttctcttttgtttgtataaatggaagtactctctagggtttctgtttaattaaaaatcttattaaatataagcaatgaaactggcttaaccaggaaactgaacattaaacccgttcacaaaacgtatgatctgactaggagaaagagaaatgtgctacccacaccaatcctggttggacatgtgcctaagccgaggtcactactagattcagtcagtacccagagaaggtagcaaacagcctttgccatataactgaatgaagggccagcctcatatctgggtttctaactgcagaacacatacatgggtgtgtatcccaggtcaggttgtgggtggcaaggccttgctgctgtataggggtcagggctcttcttgcatatctgtgtttataacaagagttgcttctgggtggcacagactaggggagacagctcctccttctagtatctttgtcaagggaacacactataaccttccatggtggttagcttaactatttcctgtgggtgtgtcccttattaaaactatatcctaaatatggtcctctcttaggaggcatcccatttcctagtcagtcatcatacatgatatacaaagagaggtatcagggcctgggctccatggctgtctagatgtttctcatctgttgtgggggatggtgcagcatgccctgagctgcctgagtcactgcaggaatgaggaagactcacagggaggagggaccaatttccttcttcagtagagtcagagagctgcataggtgagatctgagctgtgcaaggagtgggcagggcttagatgtagaaaatttttaatcctgacctggggcttctaccctgcctttgactctttagttcccagatagaagacacacacagcctttataattacaataaaccttcaacagcacaagagctgggtggatacttaccctctacgttattagaatctactttcctattgataactctgaattattacttactacttaactatgtttcatctgggctgctcttaactccaattggccagccctcagggccatgtttttatgattcccaaaccatggcaccttctcctttgtcttctgtaccttctagttctccttggttctcctctgacccatgaggtcaccccaaacctctaatccctccagtaattggctgtagagaattttatttaaccagtagctttaaatcaagggacaaggtttgcagaacacaagcttgtaaacaggagaagtcttttgtaggccaagacctttggctatagaatttagcattacaatgcatagcatcagaccaaacctcaacacttagaaactcagcaagggacaatgtgggcaaagacgtggagtgagagccccctcagggaccccatggtcacctgttccccattaaccacaggtctttgggattctgcaaacccccagcaacccccagcagctgctggaagcaccatcccatactccatgagtgtgtatccaagctttgcaattctgaagtcctatgagacaatgtgagtagtgtgtcattgtcaggattcatgtatattgtagacacaagatttaatgaaatctttctattgtcaaaagtgtttctaaaatgtttggaattacattagagcagaaagagctccaatttatgttttgctaggtaccttcccaacttagtagctttatttatttatttatttatttatttattatttttgatcatgtgcaggctcccaaagtgcatgtggaagatcaaaggacagatttgtggagtcatttctcatattctaccttatgtgggctccagagctcatacttaagttgttaggaatgtgaggaaagtgctctacccattgatctatcctgctgaccctttagccattttaaatagcaaccatttctgacagcatttggcatctgaagatcaagaattcaggggctccttagctgtgtgggtctggccccaggctctcaaaaggcagtgagcacatcttggccaaggttatgtcacttgctgttgaaagatcaaattctttgggttcagactccatcttagacaaacttgacttaagtaaattaacaggtcggtacctagctccagtttccagattacccaaaacaaaacctgagcttagctccagtttccaggctacccctaacaagatctggatctccagtttattctcctctaacaaatccactgtctagcaccaatttccaggttaatccccagcaaatcccaacacctccaggttacaaggccgcccctgcctaacaaccaccaattaggaggaaagccaacgtttggctcccagcaccagccaattacaccaaaggtcacagtagcaccccaattagatgcttgctaggcttgaaacactcacccttcacttgtgatttcctataaaaccttgtcccagtgagtgatcaaggaatttttccatggaaccgtcctgtgggtcagcagtgaatcaagacccacgctcgagcttgtgaataaagtccctggtgtgatagcatcggatccggctccttggtggtcttttggagttcatgaacatttcagcatgatactgtttaactggcatgggcattcttcttgtggtgggcatctgttcttcaaatggcgcatctctgtgtgagtgagtgtctctatggcatggtggttggtcgccactgaaatgacttttgtagaagagcaaacagataaaaggttcttttgtgccgtagtctctgtcaaaccatcacttctgctgtattttatcggccaccctgagcatccttgatttgatgcagaagaggattatgcaagcaaataaataccagaggatgtgtaccactgggaaacaaggcaaggtcacctctgaattcatattctgggaagattagagctttcagaacaggagctgggcacatgcctgtaagctccacactcagaaggccgagcagatggttcacaccagtctcagttacacaagtcagttaaggtcaacctgggctacttgacaccctgtccctacaacaaccaaatatacacgcatgccagagatgatatagtgaactagacaccctaaaaaaatttcacctttaacgtattgaaaaatactgagtagaacattttaaagatttattttggtttttaaatgttatgtctgtgtatatgtgtctgagtgtatatcgcatgagtgtatatcgcatgtgtctgagtgtatatcgcatgcatgaaatacccacagaggacagacaatgtcgccagaactctaaaactggcgttacagacacctgtgatccaccacgtgggtgctgggagcccaatcctgatcctctgcaggagcaacacaagctcttagtcactgagccatctctctagccctaagagtcaacaaataaacacacacacacacacacacacacacacacacacacacttaaatctttaaaagctgccccattatactatcaggagaataacaggtaaaaccaacacaggaggaggtgtggattgagagactcgcggagttgcaggctctccttctcctgctctagttcccagtagcttactattcatttaacaatgtttatggccgtttgctaggcctattcctcatctaactcctaacttacttaacctgtttaaactattctatgtctgccacatggctggttacttctcagtatcatatatctaatttcctcagagtgcaggtggtgaacctcccagagtttcagtctgtctactggaactcccagtttctacttcctgcctttggcaaaaaacaccatgcggcatatttggttttaccccttgacctagaaaacctcaagtgtttatttcctggccctttattttctaaaatgccaataagataggccaccagatctttaatgacaggtgatgcttcgacacagtacctgagagattatctctacagacataagtgcttaagctgggggctcctctaggcacatccctcaaccaccaagtgacagggaagcttggtgagtttctttcacatggcaacaaacaaggcacctcagctagcaagcaggaaagcaggagataacatgtgacggatgtaggcgtcagagcaaagacccttccagaaactgcctcaaatctcaatggatatttctcagtgatagttcacatcaggctttttttttttttatgagtactatttttcttggtttattcaataggctgcttcaatttaccttaatgtccacttatacttatatataagcttcttttatacaagctcagtggactcactgagaaagcacaactaggaatgcaaatcagacagcaatattaatacagagttcaccttctcctttcaatggaataaataatgcgtgcatttgtctctttctaaatatttaggcaccaaaagttttcatgggactctttcttttttattttatttacttattaggtattttcttcatttacatttcaaatgctatccccaaagtcccccataccctcccccctcccactcccctatctacccactcccacttcttggccctggcgttcccctatattggggcatataaagtttgcaagaccaaggggcctctcttcccaatgatggccgactaggccatcttctgctacaaatgcagctagagacacgagctctgggggtactggttagttcatattgttgttctacacatcaggcatttcttaattctctttccacatgcaaggagataaaacctttcctacttctacagtagctctgatggtcagggaaagtcaggaattataagcagagtctgggtttatatgggcttgcagccacgctcacccagcatgagttacagaaacctggctgatagtctgtttggaaatgtgacccagcatgagaagtgttctctgtctagaaacaaacgggagtcctgttgaagcacatgatgtctttggttttgccccttcgtttagaaagcctaaaaagattattatctggccctttatttatttttaaataaatgtcaatgttagttgcagaaatacctgcatagaagcccccagttagcctagagttgaaatacaggaaagatgcatttatcaaactaccctgtgcagcagaacaaactgaattagagaccggggcaggaggaagcttggttagacacagtcttaggcttggttaaaaaaagggggggggggcgttatgcattatgtacagttaactgggtacctgaaatagaccagacttgcttctgagcactgagggcttaatggttaactataaggagcctagggaggaagattggttcgagaacatagttactcctcaattgtgaatggagttctgcaaacagagaacattaagaggaacagaaaaggagaattcttttggaataatagctctctgccacatgtacccaggtgctctgatccccaaatacatcaaagctgctttgtcacccagtctgtgccagaatgggcttgcacaatgcatctgagcaccgagtgctaatatgctctcctgagagcagcagtggggagagtctgagctggtggcagtgagctagctgcagattgctctgggctggtggcagcaggacaagtcaattaggggagtgattgggagaaaggaaggcaagaggcacccagagcctccaggctcttgtttgaaaaatggaagacacacctggctttttccacatttccctaggtgctcgctagggcctggtcacctgctctcctgattgactcagcagggattgggttgtaaaattaggggctgggtgatgaggcagcaacttccgagtgcctattctgtgcatgtctttgtacatttatcaaggccctcaaatcaccctcacagagcagatattggccccttgttttgcaaatagggataccgaggtccagagagaggtactaagactacaaagggagatgccacccccaaatccttctttctttatctccaagtaattctagccaaggaccacatgggagggtgggtgggctcagcccagctctccttctaagaacaaaaaggacttatgatgtcccctgggctccccatttctctgtgagagtttttaggctcaacccatgaggcctagaccttcctgagaatggacaggcaatttatggtagctgaggaaaggaggaaacattttctttagctgtgtgactgaccactgatgagtggcacatgtgcctataaactcactgggtaacatacacagaggggcatgaaaaaaagaggggggctagttgagaagaagggaggggatcaggagtgggagggagagaagaaaggggagcgatgggtgaatatgatcaatatacattgtatacagggatggaaatgtcatgataaggccattattatatataattgataaatgcttttacaaaatcagaacagaaagataagctgaggaggaagttcagaatcacaaataagtaaaataacaacagggaaaaatctttctcagaacgttgctatggagatagccacatgctgtgtgagtggagacctcaggttttcctattgggcaagatgcattgagtagctacagtcagggaaagccaggaggtctgaacctcgatgccagagagcccatgcagagttgagaacaggaggaaggttctgaggagcccggagggtggatgtgggtgacaacttcagaagaagaagggcaggctggaagccagtatatggagacagatgtcattcctggacctcacggctaccttgctgagctcactttctgccagcaggagaaacatgccctgaagatgtgaagatgccagagaccggtacagaaaagcgagaggagcgttgttgtggttggttgtatgtgctgacttgatcaggctccagggtgctcaggtatttagaaaagcatttgtaatggctgtgtctgcaagggtgtcttttgatgtgtgctaccgtgacctggcagagtgaagtatacattgctctccccagccctggtggacctcatccaacccattggaggcctgtgttgtgcaaaatcgcagaggtaggaaaatgtcttccctctgcctatttttgagcgtgagcgtgaatgctcttgcctgtggagtaagacatagactggaccttacctgtgttagacctccatgcttcttggattaggatttggactagaatttatcagctgttctgggtttgctgttgtgacccacaggtcatcacactcctcagcctctgtagcactgtgagaccattagttataagaactcctggagttggagagatggctcagaagtgaagaatgcttcctgctctttcagagaactggaggtcagctcccagcagctgtatcaccatcacgtgacttacaaacacctgtacctccggttccaagggatcaagtgccctttcttgcctctgtgggcacccagacatgtgcataaacgtacacagatatacacataaataaagtaaaataaaataacatgaatcttaaaggaagaaacccagtcaatcatcacccatcctgcctgcatcctcttggttctctttttctctgggtcaaatggattgccccatacaagcatcttcttgctgccttctctacaggctggggctaaacagggaagttatgggtggggacaactttcagacagatcaagaaggaggaaggagcgactcatgattttcaaagacaacacaaatgttggcagtttggggatgtaaccgatgagggcagtggactcaggggcagacccgtgcgcatgcgcccacgtgttgccatggcaccaacaccatgcgctcaatgggatctagccacacttacgttaatgctctggtactacagagttggaacttttagtaagtttgagcgaggagtaatatatcagtggtgatgagcatgcagggttaggtcccttagagaaatggtgactagggtgggaagtgacacagctgttgccatatcaaggctagagagttgctccaccgaatagccataagtcctagtatcagcctcagagttcaggaactctgcttttcttgtttgtttgtttgtttgtttgttttcttcagacgattctgtgaagggaagatggaaagtgttaattatataaactgaagacgtttccctgtgaagtaaggccagcccatacccagccttaggctaagtttcacttgccctttcgcaacacaaacctttgtccctagatctgactaagaggttaagcaatgtgaataccggtggccaggcccttcctctccccagaagagagaagaggtccccgaggcagcagatgtgagtcaagtgccttgtggtagaggaggccactggagtagacctgggaaaaggttctgacactgtttatgactgttgggctgggcttgatcagaccaagcaccaaacgcagagctatgtatgcgcagctctgaccttcctccagggaggatttcaggatgggtgctcatgaggctccactcctctatgagtatcggtaggcaggattaatggttgccccagaaaagtaatgttttcttcagtggtgtagctactgataagttgcccatgtcattgtaaataacccctcactcaggctcttgtgattaattcactggggcacatgacatcaatgacatcacacatacacacacacacacacacacacacacagagagagagagagagagagagagagagagagaataataaaaaaataaaaatttaaaaatcatctagtctttgttaataaggataatatacttggtggtatacttaaaattggtggcaaaaaatcatgcccgtaagtaagcactgtctgagggcttgcgaaagtttctaaacctgtagttacaggcatcctcaacaaaaggcatggcaagtcattgacattagtgtcacccaggcacacagccaactcaggtgggaattgttggctctgtaaggacaggcaaaggaaaaggtcacactcaaatggctcatctctgtcatccttagtagaaaaaattgaaaatgatattagtcaagaaaggactaaataagatgatatgcctaatattcagggagaccaggataatgtttcaaatgccctggaataactggctctgtgtgtgtgtgtgtgtgtgtgtgtgcgtgcacgcgcgcacgcacatgtgagtgcacagatttatgtctgaatggtcttcagaaattaggtgatattccacaggaaggattttccatcctatcaagaacctaagaatatttcaaggaaccagatcactatttagggaagagggaaggtcgtgtattatattagccagatatacttcactcagatatgattttggattacacatggtggtgcacacctttaatcccagtacttgagaagcagaggcaggacaggagacacccagggccaacgagacccacatgaatgcacaccccctcatgtgtcagtgagagctctcgcacactctccctctcataatgagaaatgagaaaaggagaaagataaaatatctgctattccttgtattagtcaaaaaacttcctgcgtttgaggatagcttcgtgtgtacttagatatttagaaagtctcaggtaaaccagtgcttaatagtttgtctcaaacaaacaaacaagcaaacatgatttgaaccaatggcattgggtaggaaggctttgggcttcagataacaaagctgaaggaaggtctgctctagccacagctgaacgtccagtcctcttctctaacaggaagtctgcaggaagttgctctccaagtccacgcagcacttccagggcgtaagcagctcagagtctctgaacttgcctgcttgtttcgctgcttcctcttccactccaggtgggaaccacggctttgagcgacagagtctcatatgtcagcttcttgaggcaggagagagagagtgataatgctagaggattgtcttcccccttcccccccccccccgccccactctgacaggaagagccttcgccaccgtgacaacctgcctgcgatcatcttaacttagtggatagaccctcagacgagtcactggctgacaaatatagacacccatgattggcttacagcatagtgttcattgcttcctttcttttccatctgcagtccagtggggaccattaaaactaagtcaaagggaaaactattcatggttttttaaaatttttttaaattttaaagagagaaatatgaagggctagggagatggctcgggggtcacgtgtgtgttgtacaagcatgaagattagagtattatcttcagcaagaaggtaaaaaacctggatgtggcaagacctgtaatcttggcactgggaggtagagaccgaaggatcctgaggcttcctggtcaatcagcatagagcttcagatactgtgagaaaaccaaatggcagagagggataaaagaagatccccggtgctagcctcatggacatgcacacaagcatgcaagaatgcacacgcgcgcgcgcgcacacacacacacacacacacacacacacacacacaatcataatgagagtagagaaaagtagaaagaaagacagtttattattccttgtattggtgaaaccctccactaaggggcaaaagctattgtacaccatgaacacctgcaggctcaacccttgggtgcagagggagaagactgcacaatgaattccacaccaaccatggagaaacataaattaacgaacaaataggaaagcaagcaaaaaaaaaaaaactagactggaaggagggattctgggtcatggaaatatcattcgccattgatgaattttatttttatgttcatttttcagctccatccctactccttaatgtcgctgccatgttcctgtgctatggtaaatctcttgatttaaaccaaaagctttccttacttcctttcagaatttcacttacgttactctctctcctctccctcacttacaatgaataatcttggaagaaaacatgtctgcatagaaaaggactttctggttagttcataatgttgttccacctatagggttgcagatccatttagctccttgggtattttctctagctcctccattgggggccctgtgatccatccaatagctgactgtgagcatccacttctgtgtttgctaggccccggcatagtctcactagagacagctatatctgggtcctatcagcacaatcttgctagtgtatgcaatggtgtcagcgttcggaagccgattatgggatggatccctggatacatcactggaaagagaggcccattggacttgcaaacttgatatgccccaggacaggggaacgccagggccaaaaagtgggaatgggtgagtaggggagtgggggtgagggtatgggggacttttgggatagcattggaaatgtaattgaagaaaatacgtaataaaaaaatattaaaaaaaaaaaaagaaaaggactttctaccttactggcaactgtaggctcttaggcgagggctctcgcctcagtcatacgcgtcttcctctctgtaaagtgagctggctaaattagacacatccgaaggtcacatagccccagttctgaaacttgatggttctaaagtctgcggggacaagcacatgacccttctccaacctctggtatcaggttctgttcccactcgttttattcattatctgctctgtcccctacttaacccagacttatttgtgcagtctctgaatgagcaagccaggctttttttttttggatgatattattagatgctcctgaatattctccaagtgctttaaatgaaaactctggacagtacagccagacttcccaagttgccaacttgtcccaggccttagaagtcacctaattacattgaattctgcctggtggagatgaagacagaaagcctgtcactaatggtgcatgtgttgagggtggtgaccactccatctttattgccagctatgctaaagcccttgctgcatcagaaggagtgtgagcttgtaaagttccgagtctgcagcatgatcttccattctctaagcggtaaggcttaatgtgtgtgtgatgctgaccagtgaaggaagattctagcaatattctgaaagtgatagataagaaatcaatactaaaatccatggctgagaatccgtctttggttaatgggtagccacagaaggtgggagagagatttctggatacttcaaggagcagaagaataagatcagccagaggggctgctctgagcatcgattgctgctgctgctgctgcccctgccgccgccgccgccgcctttgtcgtctttgtgtattttgtggcgctaaaagaatagcaagcaccaggcagcttctaatgaacaaatgcttgtgattctggaggccaaatccaaaactgagatactgacatctggaggggccttctggctgtgtctaatatcgtagacctcatgtggcagaaccacaaatggagagagaaaactaaaagggtccacactcactcttcactaggaatccactcctgcaatggtggtcgtaatcccctcaccccattctttcagctgaatcttttttttttttcatcaggttctgccgcccaacgctattgcgtagggagtacttctagcacatgcttatgggagtgtgttatcatcacaagagttggtaactttcaaggagacagtgtgagggaaggctgtagaaatatttaagaggcaacagacttggtcagtcaatgaagccagaactctaaggggaagtgtgatgctcactaaaggaaacataaaggactccacccctaccccccacccccgggtgaacagaactcttctgtgctgtcccagccttgcacaacagcaacactgataccctactcccacagtgacagaaaaggacttgggactcctatgaaggacgagggacttgactagagctcactaccttgacctttcactgttagaagtggcataaggtgaagagctacagcttaggggctggagtgatggccacttgctgttcttccagaggacccaagttcagttcccagcacccacatcaggcagctcgcaacaattacccatgattgctaccattgatgctgatgccttcttccaacttctgagggtacctgcattcttgttctctctctctctctcatctgtaaaaatcatattaagaaaatatatatttgggtttaaaatcaaaatggaagatacaggttatagagatatatttagcaaaggaaccaagaacacttgatttctgtgccagagagtcacactttcctcaaagagctcccaaggagaaacaataaaaataaatacagctcttactttgcactagatgctgttaggagcactttaactccattagctgattttgttcttataacagatgccagggcaagagaaagctgtatcagtcacttgagaattgaagttgatttcatggcaggcggtgggacagagagaggaaagtgggctggtccttacaaagcacagatgcagaaaagttacactgggagacaaaaatgagaagagatgcagagtagcctggctagctggctgggttcattcatttactcattttacctttattgagatggttagagggtaagtctgtgctcaccatagtgacaaacttttaaatgatgcttgtgcttcagccccctccagtatcacctcagtcttatcattcgaacacttggtcctgacgggctttgctttttgaccttgtacatttttttaaaaagcgatttttatttctttttatattatgcctgtgtgatgtaattgtcccacatgagtgccacggccacgggagcctgaagagagtgtggcatcttctggaactagagttacagatttgtgagccctgtgtgggtgctagaaaccaaatccaggtcttctgcaagagcagcaagcactcgtagctgatgagctatctctgtagcttccggataattattttgatgacaaatgtctacctgagcctccatttataacattgcaatcattcctagagatgtgcactagtagatttgtacaatagagtgcaaatcagcatatttcatgaagacttaaaagcttaaggtccttcagccatttggaatgggcaaactgctgggacatttataccatgcagtgttgtatagcagagaaaatgggtgaatcatcattacatgtgagtgaagggctggagagatggttcagtggttaagaacatgtactgctcttacaggagcttagtacccagtaccatgtcaggcagctcacaactgcctgcagttctagctccaggcgggaatcgaatacctctggcctctgagagcaggcatataccaccatacacatatatgcataatttaaaatgaaaataagttttgaaaacaattaaaaaataacaggatgaataaagactgaacaacatgtttgagtctatgccggggcctagcaaacacagaagtggatgctcacagtcagctattggatggatcacagggcccccaatggaggagctagagaaagtacccaaggagctaaagggagctgcaaccctataggtggaacaacaatatgaactaaccagtaacccggagctcttgtctctagctgcatatgtatcaaaagatggcctagtcagccatcagtggaaagagaggcccattggacttgcaaactttatatgccccagtacaggggaatgccaggaccaaaaagggggagtgggtgggtaggggagtgggggggtgtgtatggggacttttgggatagcattggaaatgtaaatgaggaaaatacctaataaaaatattaaaaaagaaaaaaaaaagactgaacaacaaaaacaaaccagaagttccaggagaatattggctccgcactttatcttttttaaggtccaaatgccaaaacaggtatttaggtagttgttgtctaagccatttgttgccgatttaagtaaaagtccatccattttctgtgcctgctaaaattgatacttttaaagcaagaaaatgaaacaggaggaaattcaaggtggaggatgtctcggtggagcaggagggcgtgaagagagagcacacggaagtgaggctgttgaccgtgttctcactgtgctgggcagttgagacatagatacttatttggaaaagaattaaactcgagggactcagtggaatggaaaaagtcagctatgggtggaacaccagaccatttcatgaactgggacttgtaaatgttctcattctggcacctgctgagctcctagtgacataagagacctaagctccagatttattccgaattaacaaattgagccagatcctcagatctcgtggaagaacaagcaggtgctctcgactaatgagccacctctccagtcccaaggtatagagctttgatctccatttttctttatgtacaaatatttccctaggcattaaaggtgtaatttccataatctattcagtgtatcaggctgtggtcatactgaataagaggttttcttcacagaagcatcctgtacattaaatagaaagatcaattttaaatgacacctgagcttactccagtgtctctgctaatttgttgaacttttccttcataatctctttaaattaattattaactagcccaaagcagggtggacttgggcattatagagtacctggtcaatttagaaatcgtttagtccaagtcattagaggattattacccttttttttttcttcagccagatgggggatgtcataaatgtacacaattagggttctttaaattaggcttatggcttggatgtgaaatgtcccctagaagctcacatgcttgattacttggtccccagctggtagcactctttcaggaggttggacagacacacagtctcattcatagttggtggggcatagggatgaaacttgagggttacggatcgcctctgattctgtcctggttgctctgtttccagatccagtcacatgtgagcaagctatctcacactcccgttgtcataacggactggttctgtttccatgtgtttctcatggcggtgatcgactttatcctctgaacctcgtgcaaaccctccatgactcaagttggtcctcctattaggtgtttgccctctgtcatgagaagagtgacacccatagtaggctcctttccatccatctcgcatgtgccccacggtcaggttctgttggtctaaggctgaccatcaactgctgctgaacatatatatatagttgagaaacttttccagtcatactttccaagaaataaataggagcttgagtgtggtgagctgtagctctcagctggccactgatgtaattattaatcactgcatgcaattaattgggacctttcttagacatgtttgccactgatccctgtttccagggagtttcacaaatgttcccaccccagcctcgtacctctatttgttcttttgtaactttataaaaattttaatctatacaagtttgcaatgcattgatcatatctattcccaccctcaccttcctggttatccgagattctccccaccatatccctttgaagtgtcagatcttcctcttctgctctttataacctactaagtggtgttcatatgggcacaggtgtaggaacattcaccacagcatgagcaacctgtaagagaccacattcctgaagaaaactcccctttctccccaggggacatcaacggccaataactctcagttatggatggggtaccttccgtttatcctggaatgttgactggatgaatctgtgtaagcagccactgctgctgtgagttcgttaagtgtaatggcctcatgttgaagttaagccctggatcttcctccaagctccgtgctcccggaaataaggctcagactcaaaatatatttacaaataccttggccatgtaactaggctcttctctgactagctataacttgaaataaccattgattctagcctacattctcccatgtgattggcgatatgagctcaggtaccaggcatctgtcttgtcacatcttttcagtgactctctctgcctccttctctcccagaattctttctcctcccacggttcaccttctatttcctgcctaagccatagcccatgggctttttagctgacaggtgatgcattcatacagtagacgagatgttctgtttatagccttgccatacccagaagacactgtgtcacaacagtcactccccatcctgacctgcagcccttatgaccttttggccctctctttcacagtgttccctggggggtggtaatggtggtggtatgcatatatgtcctgttttgagagcaccgcatggtcattccacatttgttcttaagtggaagaaagcatgatgcaaaacagaaggagtgagctagactttaactggatttaggggactttataagagaaagtaaaaacgtcctcaagaattcattaaaaatgaagagcatctcccccatgctcatttctgttcattacaaacgactcaactattacatgcaaatattactctaggaaaatagccacccactgatatgggtgtggagatctccaaagacaagaggaagttgaaaagggctcagatggctcctccaatgtggccttccagcttatgacaagagaaacacaattgctggtccagggacagatgtctgctgcacttgctttgttcctggctctccctctgacccaatttacagcccccctgcagctgtctcctgcatactttcccacgtgaagttatttatctttcttaacagtcaactcgatttattccaagagaatgctcccctcccccagctctgctggtaatctattcctgcactaaattgccattgtaatcaaaattcctagaatagtttaagttggccttctgcagctgcagtcacctctgtcaaagccctggccaagcctcctcagtgccctggagtgagtgtcattccacattgctggaaaccacaccccatctggctcttcccgcctttccaggctccttttgctgtgtccttttatcatctctactgaaccactttcctgacaaagctccaacacggttcctcctctagagctaccgacctcttcaactcctatgtggtcatttttttttctgtccttggccatttcttaacccatttttttaggacatcctcttctctccttgaaacttggtcagatctgccaccatatgtaccacttactcaatattttgatcccggagctcagttccgtggtggctaattttgtcaacagacaacatctggaatcatctaaaactcaagttgctgggcacttctgtgaggcagttttttaaaatcagattatttgaagcaggaagacacatccgacatccgggccccactttctgatggcagcccagataacatgacgtggaagaaggacacttggcttttttttttttttttttttgcctgcttgccccactgtgtctggcatctctcctgttgctcaggcattccttcactattcagaatcccaacaaagatagaaaaccatctgctctccaggaatcctccaggatcccagagctaggtgaggactgctgagacacccagccttgtggactgaacagctgccagtttagatattggtctttccatcatgagactgccattgttgaactactcggaccatatcctgtaagccagccttataaatgcatacacacacacacacacatgcacacacacacatgcacacacacacacacacacacactcacactcacacatgcacgcacgcacacacacacatgcacacacactcacaaatgcacgcacgcacacacacgcacacacacacacacacatacacacattcactctcagttctgttccttcagagaagcctgactaaatcaggttcccagcacctatgatgggcagttcacaatggcctgctaatctagctctgggagatctccttgcttcttctcatctctgcaggcactgtactcattgtgcacacataaatactaatactaataataatagtaatgaaaattataaattcatatgcataccagtttttattagttggcaacagattgcataaccacaacaccacttcacaaccagaaaattgacagactatactagtcatatccaggtttcatagttttgccctgtgcttagacatgcatattttcagctattcattgattgcttgccatactagaaactgacctacacaggctaagccagtgctctaccgctgagatgtatccccagccttctggttccatctgacttaagttgcccaaggtagcgttgatcccaatctgtaacacaggcatacctgaaacttgcaatccttctgcctctgtcacctgcgtagttgagattttaggccggtgccactctgtctgtaactttgttatgtggagagactcgtgtgcctctctatgagatacacttgggaagaaagaacctgccggttaagggatggcctccatcaggttgcctatggggatgtgtgtggtaccttctctgtccagtttactacggggagcatcttccctaggcaggtcgcttaggttgtctaagaaagctagctgaacacggagcaaaccactaaagggcatccctctgtggtttctgctttaaggtcctgctttcaatctgtctcctgtcagatgaaacaaaccctttcctctccaaattgcgtttggtaatggtgtttatcatagaaaaagaaaaccgagaaaaagaaaaccaccatagtcaaacttagactcgtcccatcagtggcctcttgtgataccttttagaaccaactgccacctgtcccttctcccgacctgtgaccagcaataatatgtctccagatttatactttgattaattttaagaatgttgcataaattttatcaaacaccatacggaagtctgaaatttccctccccagcatgattctcttgatatccacctgagttgttgtgtagaccgacactgttctcattgctattggtgagtagtatttctgaatgtggacttggtagtttgtctaattgctcgcttgttgtgagatgcttgggttatttctagttattgaaaatcaacatatatgaaaatgcatatgtagattttgtgcactttcacttctcttggataaatgccttaggaaaatgttttctgggtcatatggcaggcatatgtttgatttcctagagacatcaatgcagtttttagactgattgtcccattttacattctcagtagctgcgtatgagtctgacatccttgccagtgtttgttgatgtccttaaattttttgaaccattctgatagtagggtaggatctctattttatttatatatgtgagtatgtgtttgtgtgtgagcatgcgcatttgtgcatgtatgtgtgtatgtgtgtgtgtgtgtgtgtgtgtgtgtgtgtgtgtgtgtgtgtgtgcatgtgtgtgtggaagaccatcctcacccttggagctggagttataggcaattgcgaaccacatgagatgggaagtgaactcaagtcctctggcagagtcctctgtgcccctaaccactgagtgacccctcaactccttagtgtatcatactgtatgtttactgagtgtttctatgatggcttatgctgttgatcctcttttcatatactactttgtcatctttatagcctctttagtggcagatctgtcttttctaagtttcctagtctaatattttaatcactgagttttgacggttctttatatgtcttagatagtgccaacctccactctgtttagatgagcagaaggtctatggggttaaaaggctttttcagtcatttagcaaccgagaaaggaaagatccaagtctgcccctgtctttatgcagtctttaccatggctcatctcatatgtagtgtcttcccaactcatcaagctacattcatcttagcatacatagtctcccaaaccaaaaacccataaccagggtatacatccttttggtggggaattgtctgaagtttgtcttctaaagtgtccagcctgtgttagtcattgtatcgccctatatagtcaacaggggtggggatggaacacaacacctaagtatccctttagccccgaagagccttcagttgtcactcctcatcaaaactatttaactagagtcatctcattcaaattcaagtccccttgccagattaaaatatagctgatgagtagttatcatgaaggtaaagaagccagtcacacggctagggagatggtcaatgggtaaagtgcttgacttgtaaaccctaggacccaaattcatgttcccagcaaccacataaagtcaaacgtggcatcttgtttctgcaagccgaggtgtgaagggtgaagaagtgaatcccagggacttcgggtgggtcaatctagttgaagcgatgagttccaagtttagtgagaaacaacgtcaaaaaataaggaagaaagaaattgaggaagacattgtgatatcatcctctttcgtgtacatgcacatgggtaggtaagcacgcaccactcacacacacacacacacacacacacacacacacacacacatcaattcttcatagctctaagtggattctttttgtcaaagaatcagctgaagcttaatggagattgcatacctgagctcttgtcttctacagggattgtaagagcaatgcccagatgactcttatgtacacagctgtcccagagtctgttttctaatcactcagcctgtgaaaactggtgccatccatgacttgaacaggctggtggtcttgggagccagatcactttcccagtgggcactgaggagctccacctgccaccagatagcagagtactgattaggccttgaaccagaaatgaccagaaaagcatgttatagatgagaatagtacagtggatgtcatgttctaggtgtctgagaaatatggaggaaaatgaccctaatcataaagaaattatagggtagatattaagcacgcctaaattattaaccagacaataagaggacatgagagattaattgaaggttaatagctcattgtgaaaggcaggggcctctctggtagcttataaagatgctcttggcttttgcaacctgaggcctgagaaattgtggcctatgacttaatagtaagaatggtggaacaacaatgaagggttaagacctgaagtgaggccatgtcataagttgttgggccattgtcctcacccaggttaggaaacaatggaatttgacacatatggcaggagtggattatgtcaaaaacaataaaactgaattgaattaactgtattggatctagagttgttttttttttttttttttttttaaattctgtgctgtaagcttccagaaaaggcatactccttcctgttaaacaccagtgctcttctgatgtatcaggactgtattagttacctctctgtgactgtgagaaaacaccatgacaaaggcaatttgtagaaggacgggttttactgggttatagttccagagagataagagttcattatggcaaaaagagaaggctggagataggtatgggagctgagcaggaagcgcaaaggccaatggcaaacatgaagcagagagaacaaattggaagttgggtaaagctcaatgcttgttgttagtgatgcacttcctccaggaaagttatagccccacactcccatcgcctctccaaacaattctgccaacaggggaccatgtgttcaaatgcctgtgggagatagttcacattcaaactaccacaaaaaccatacagtgctccatgagttaggaaaacatgcctgctttaccagattctctcctggtcaccaagctaaaccctaaggatatatcaccacaacctggcagaggactgagcttggtctggtaatggaagaaggtataaaccaaaaggaacatcaggtcctagccattaccataagtgggactggattgtgtaagttttgcctcaaaggtggcattattctaagttagatgatggaggatctgtttcttgaggcagggtctccttggatacaggagttaccatctatcaagataggataaagctgtggctggcatgaatagaatcatgatagatgatttaaagcctatgtgggggatggaagcagcctcccctaaagtaaaagtggaaatgcattattgtcattgctatggatgctttctgggcaataaaagacagtgggatatgacatacagctagaagtcttatttaataatttctattatgatgctataatgcaaagcatggagatacggacagatacgatgagtactggtataattaagaaattcagcagtaaatagctcctgaagtcatttctaatcagagatgtcattgtggagattgtggagattgtggattgtgacacagataggaagatcccaaattaacagccgcaggggttccatttcaaacttagatgccaggtgacagcatttaccaaaacagaaggtcaagtgcaaaagaacaatcaggagatctgactccaagataacaatggcaattgtcaacacagcttcctagcgttggggagaaaagagatgtcaagagacaataaaaccattgcacgcaccagagcaagaggagccaagagtgtatgagcaagatcctagagacaaggtttctccacagtgtgttctgtcacccaggttcagagctggcccagttttcaaacacagaacccaacgatgaagtgatcaggtgtcctggaaaaaaaaaaagatttcttcaaaaccatggtgacttaacaggtaacaattccctgacacttccctgaagcaatcttcaatcaccaactcagttagccataagttatgggaatgtttggttccaaacatgtcaacctgacacaggatcatacacagattcaaagtatcaacatgaaccttctgttacactgggagcacacctggccatgaatggaagctcagaacagtttcaggattacaatgtgtccacagagtaggtaggctcaaccagtgatcctctctcctgtcccagaatgtaacattgaagaagtgcacttggcattgggcccagcttgggttcctttacctgtggatgaaacttaatgagggaaacattaataacattattaacattaataacataattaaaacataatgaggggttggacagaagcaccaatgagaaccctgttgctcaaatctgccccttacaaaggtataaaatgtgtgttctttctttgttctgggtctctcctctggcctgcgtgctgagaggggagtccccaacatgttggatcaataaaaatccaataaggccacactcctaatagtgccactccctagcccaagcatatagaaatcatcacattccagtctctgaaccccagaggcttgctcaaacatatgggacataactaaacctaacataatgcaaagttcatttagtccaacttccaaagtcctcatagtctgtggcggtctcaacaatgttttaacttaatcttttaagaccaaagttcaaggtctctactgagatttactcaatcacttaactgtaatctccaaagcaagacaggaaaccaaatgggtaaactccaaactttggatcttcatgtctgatgtcaaaactctcttcagatctccaacctcttttttatctttgttgactgcaacaaacttctttctcttgggctggttccactccctgttagcagatttcctcagcagatagttcatggctctggcatctcaaacatcttggggtctccaaggaaaattcaatgttacagcttcttgtttcaatgtctgggatccacacataatcttctgggattctccaaagggctggtgtcacttctccagcactgccctcggtggcattctaagttcagagtgatccactccactgttgctgctgttcttggtgatcatcccatggtactgtgttgtgtctgctcttgaccagcaagaaagacacaacggccagattcttctcaacagcctttattgcaggaatgcctcaatgctgctacagggacctagggaacccagggaggtctgcttatatactctccagcacagggaaaggcttcatggccccctgggattggtcagtctgccggcacctaatttgcatgcacccgctccggaggggttggcgccagactcggacttacatctgcgctgatgttgtttatgacaatggcacacctggtgcccagagccatcttagagttggcttcctacagtactggtatctccaatactctggggccttctactgcaacgaggcttcaccaataacctctcataggttctctccatggtgccaagcctcaacttcttttcatgaccccttcagtcctgggctgtcaagtgcaactgaggctgcatcttcaccaatggccttccatggcctctcagagtgccaagcctcagctgctctttatgttcccttcatcccttcaaaaccagtaacacctgagtgatggggatggatgtagatgaggtgaaacccagaacacctctcattccctgcaagggaagacccatgcctgtagccagaaatgttaggattagagcaaaacccttagtagaaactgctgtgattctcatttggaagaccatggactgatctgtcagcagtgttattggaggtagcctttttctttctccattgtgaagttgatggtccttgggcagacttcaagaaagggtctgaggagacagacccaggaagagtgtagcaataacatttgatttgcgattaagaaggctggagtcataattagccctaaatgggacaactctatcaccctctccaatgctcagggaagaggagacagaaagaatgtaaaagccattctgggcttgacatagctgttgtcttcatgtggtgacctgcactagagctgcaggcgactgggcattcatcaagtgtgtgggagggtcccctgaggccccacccctcccttcaggactaacagaagttagtgcttgccaagggagtagctatcatcctctgcagtgacacggaagctgacaagttacccatgctccaggaaataaactcccacccacgctcaggcaggcgacttaccttagactgagtaagtcacacacaaaagaagacatgaaagaaggaggggctcttcgttgagactaagggtttcaagtgggagaaagagaaggataagactattaaaattcattacatacaggtatggaactgccaaagaagaaaatgatgaagagcagcagctgccgccaccgggagtgagtcagaggtggcctgcaagcctgcaggaacctggccctcaccaacagaaaaggcggaggacagacacctgacaagagtgttctcttccctccactaagtgtcttttacagtttacatgttgatttgggagactgttaattctgggatatgcggggggtggggtggggggaacaactccaacattctggaccaaatttaaagcaacctttattaaatattagatattgaccaagggatggaccttagttgggaccatttcacagaacttcccacctgagaatggcctgagccatgggttgcaggggcaaagggcaaacctataggccactgtactttcccatgatgctttgctgtttcctaagaactataattcccagcattgcaggaagttactgggtttctgggcaggtaaggcttacaggttaattttgggcattataagacaaataccaaaatattatctatgatactattgctttattttattttattttcaattacatatgcttgtatgtgcatgagagtgcaagtgcccacagaggttagaaggaggtattaggtatcctggagatggagttacaggagattatgagctatcatatagatgttggaattaaacctcagtcctctggaagagcagccaatgagccatatctccagccctatcaacctgttgggttgtttaaaaataattcttttatttttatttttaagtatgtgtgtgtttgtgtgtgtgtgtgtacatgggtgcagtaccctaagagaccggaagagaacattggattccccccccccccaccgcccccacctcccgagctggagttacaggcagatgtgtcccttggaaaccaaactcagctcgcctagaagaggactggactatcgagcctaagcgcccatctaagtctttgtatccagtctttctgcaaccctggaagcctttttaccaaaaagtacattctttcatcctagctgttttttgtgactagcacctgctgaaaaaaaaaaataagaaagaaagaaagaaagaaaaaacccaaaacatcatcaaaacaacaaaaagccaagcccaccaacaagaaacggatatacacaaaagccaagaaaaacaaaacaagcccccccaagccccagctattcatcaagataggaaagagaaacacccaactcctacctgcgcttggtgattgcttggtgaaaaataaaagtatttttcctctcattccttcttttgtgatcaaatgaataatgaagggattgagcctttgctagtgtgcatgcccctgcagggagccaagaaacaaataggtttcctaagggtataacccagccttttcggcttttccgtcatcacgtgattgagggcttctgcttcccacttaacctgcatccttcccagactgattcatggaacctcaagggctctacaggaaaattcaaacatcagcttctctctgccataggacttccatccgaaggaatggttccttggttgttgccttcacagccctcacatccgggctggacctggcagaaagttgacatttgacccctatctagagcatagacgatgctggcagccgtatgtcctcacttttgccattccggtgcctccctcggggcacagccaaggttccgagatgggcattttcaggaggaaacgattttatttgaggtcttggcagggagatgagaggaggaggcgtgccaccttctgtaacaaaaggcatttcccagccttagacacacccttaggcccagatgtacactcccactcctgtcaatccaactgcactgactagcaaccctaatgcctgctgcttccaggcaccccgcagcctgcgtcttgtttccactatttcctctgcctgtcgcagggaaagcctcactaccaagagccttcaaacacagttcctgttactaattttgccccaaagggtaccacagtgattaacttaatgcttccccagggatgactctctctgtctggggtcagggtggggctggatggattttctttattaaggatggtgggaaccctcttttgagctttgaagtctcgccttagatttttttttaattttattttttatttttgataactacaaagggacaggaagtctctttttactcctctgaggcttgctgttctccaggggcatggaaaatgtacacgttgttagccccccaagcctgggggctggggcccgcgctctgccggattgtttttatatcccagcaaaaagcatctgtgtgcagaacagcagctggtctgctgctgccaactgcacgttcccagtaccaatgtaagcactttccttagaggttaaaacccccaaggcactgtttgtgtttggagaagaaatgctctaaaaatagtaagtgggggtttaaagtctcttcgtcagatgttcggaagcacgctgacctggtgcgctgcttcttagaaccagagctcattggcaggttgctgtgccttgcacctacgattcctgactccttcagtaagctagctggtgaagagctggagaatctgtatttataataaatccccgggtggggcattgatgttgctgattttaagaacacacactgttgtagccagtcaaaagacccttactcagaaagaccacagagaccgccgccatcgctgcaaaccgcatgaggatttttattgatccaacatgttggggacacccctctcagcacgcaggccagaggagagacccagaacaaagaaagatcacattttttatacctttgtaaggggcagatttgagtaacagggttcttattggtgtagcaagtaaccctttcaggcattggttggtttgtatagtgactaagtaaccctatggcccagtgactactttgcttgcccccatggtgggttattatgatttggtcagcaaagtaatagtactttaacatcacagctattaacgtcaagggaattctcacaacaagctcagggtggtttgtggtctttgtcagaattcagtgtggggcaggggtcaggagaattgctaatcttgttatggttacttctctgagaacagctagtattgttttggtagttgcaagcttaatcattttgaccaccaaaactatgtttttacatttgtttagtcagccggcttccctatctggctctgcacgtggcctgcaagtacagtttggaaagtgtttttcgaaggaggaaggtactgggtggtcttgaattcattttggatattacaacacaaagaaccactggtctggtgtatttccccccagtctgttgttggctgcagggtgtaatacagacacagggtttattaccagggagaggagggtaccatagcttgatgcaattccttattacctgtgtcgccaagagcaagtagcttaaccttgctggtctctgtttcctcccttccttgacaatcatttctatagagctaatttatatcaggatcttaattatcttgttttgtggagggcacatgtttataaaacgttgatctttctccctaccaatattttttctcattgtcatttaaagagtcagttttgggactgacaagatggcttagtgggtagagaaggcttgccaccaaccctgatggtgggagctcaatctttgggactcacaaggaagaaggagaaaacagactctgatctgtacacatttaaattggcacgtgagcccttctcctcaaataaagtcacacacacacacacacacacacacacacacacacagagagagagagagagagagagagagagagagagagagagagagagagagagagagaaagatacacacacacatcccatacacattttttggccaggttagacaatgctggggaaagatatcagatttatgcatctctctctctctggactgagttggtgactgtgggaagggatgggacttgactactgcaacttgtcagagcacagtaggccactgtgaattgcagctctcagactcctggtaccatcccatagtccagcacatgggagctaaaagtccaaataacaacaatgctgtctgaggacttggaggcaggtgacattgtggtagggatttgtggatttcgatgtgtgtttgttctctgtttttaacaccttccatcagataagttcctgtcctgtttcttcagatcccaacctgttttccatttccttggggagcctttgaaatatgtggctggatctggatgttatgaacttgtatggagttctgcacaagtctttatagtttcatttgattgcaatccaattaatgtaaggatcctccctgaatgatgcgccctgtgaaagcaaactccatgcttaatctcttccctatacttgtgtagtatgcatttcttgacttttcatgagacattcagagactatcctataaaagtgtgtaagtcataaaagtgtgagattaaaaaaaatagcaggtgcaaatgaatcacattttcttgatccattctttgggaaacatctgggttgtttccagtttcttgctattacaaatatagctgctatgtacctggtagaacaagtatccctgtggtatggtggagcatcttttgggtacacgcccaggagcggtatagctgggtcttgaggtagaactattcccaattttttgagaaatcaccaagctgatttccagagtcgttgtactgttgtggccggccagcagctcgcaacgtgaacgtgactgagatggccactcgagctaagggaggaactagtcggggagaaagaagaaacggagccaagacaagttcatcctgttcaaagctcaattttactagttctgacattcagttataaaggaagggggagggaacccgattcccgccaactggtcttggagtccagtagcagggtgaacacgtgtgtggctccaagcagcaaagcagcacggtccagcagtgggcgtggcagaatgaatgagcgggaaactccacccctgagccagcaggttccaggctgggggtggggaggctgcagttgtacaagtttgcacctgcaatggaggaatgttctcttcgctccacatcctcaccagcatttgctaactcttgagtttttgatcttagccattctgatagatgtaaggtggaatctcagagtcattttatttgtattttccagatgattaaggacattgaacatttctttaaatgttcctctgacattaaagattcttctgttgagaattctctgtttagctctgtactctattttttaagattggattatttgttttcttggtgtttaagttcttgagttctttatttatcagtcctctgtcagatgtagggttgttgaaggtcttttcccatcatgtaggctgcctttttctcctattaattatgtcccttgcattatagaaggttttcagtgtcatgaggtccaatttattaactgttgatcttagcgcctgaaccatttgtgttctgttcagaaagttctcttctgtatcagtgcattcaaggctatccccactttctcttctattagttttagagtatccagttttatgctgaggtctttgatccacttgcacttgagttttgtgcaggatgataagtatggatctatttgcaatcttcctcatgcagacatccagtaggaccagcacaatttgttgaagatgctttcttttttccattgtatggatttggcttctttgtcaaaaatcaagtgtctatacatgtgtgagtttatttctctgtcttcgattcaattacattgctcagttattaaaagcaaggacatcatgaagttttcaggcaaatggatggaactagaaaatatcatcctgaatgaggtaacccagctccaaaattataagtagatattagccataagtatacatacaggatacccaagctataaaccagaaacccaattatgctaaataacaaggagggctcaagggaggatgcttaatctcactgagaaagtgtcctagtcagggtttctattcttgcacaaaacatcatgaccaagaaacaagttggggatgaaagggctttttcaagctacacctccacattgttgttcatcaccaaaggaagtcaggactggaactcacacagggcagaaacatggaggcaggagctgatatagatgccatgaaggggtgctgcttactggattgctcccctagcttgctcatcttcccttcttatagaagtcaggaccaccagcccagggatggcatcacccacaatgagccctcctcgcttgatcactaattgagaagatgccttacagctgggtctcatggaggtatttcttcctcaagggaggctcctttctctgtgataacttcagcttgtgtcaagttggcacataaaaccagccagtaaaggaggagaaacaaaatagtcattggaggggatggagggaaggaactggttgagagaggggctggggagggaaatggggagttggtcatcaggtgtagggagagaaggggaaagggggctgtgagagtgaatggaaatttgtggcaggtgggagtggggtgggggtggggaggctgccatatcatttctaggatgtgtcagagacctgggacaggggaggctccaggtagactatgaggggcctctagctgagattccttgtaatgggggatatggagtctgaaatggtcacttcctgtggccagacaggacctcccagtagagggaaaaggataccaacccacccacaaaacctttgaccctaaatttgtcctgcctacaagaagttccgggacaaagatggaacagagacaaagggaacgaccaaccaatgaccagcccaacttgagacccgtgccgtgggcaggaactaatccttaagatttaatgatactcttgttatgcttgcagacaagagcctggcatatctgtcctctgagaggctccacctagcagctgactgaaacagatgcagagactcatagccaaacattagacggaacttggaaaatgtggaagagttgagggaaagattgagggacacagagaggataggaactccacacgaacaacagagtcaactaacctggactcttgagagcttccagagactgaaccaccaaccgagcatgggctggaccttggcatcctgcatttatgtagcagatatgcaccttggtcttcatgagagtccctcaacaactagagcagggactgtccttgaccctgttaactgcctgcctgtggatcctattccaactgggctgtcttgtctggcctcagtggaagaggatgtgcctagtcctgcaatgatttgatgtgccagggtgggttggtacccagcacccccctcaaaggagaagaggatgagggaggagctatgtgatgggggtactgggaagagaggagagatgcaaattggaagtaaagtgaataaataaataaattaattaatggaaaaaagtagtgggtgctatgaaggagtcatctatattagattttctggagttataacaaaatacttgagagaaatggagttattttattatcgttttggagataaaagtccaaataacagtagtattatctgtggtaagaactactgtagatggcactgtgataagaatttgtcagttcctatgtctgtaaatgtgtagcgtgtgtgtgtgtgtgtgtgtgtgtgtgtgtgtgtctgcatgtgcatgtatgtggggtgtctatgtttgagatggatatggatgtgctgtgtgttatatgtatgtgtgatatatgtgctgtgtatgtggaagttatgtgtgggtatgggtgggggctatgtgtgaaagaaagagagaaacaggatagggaaaggaagtcagagccagacctatatggggacagtaatgacctccttatttagatttatctcttaagggttaaagatgacattattttttaacattgttgctccaggaccaggctcctaatgcatgcagtctgagagacacattcaaatcatatcctatacacagtaccatcctttggccagaatattggtaaaaccatccaaatgttagaggagagtagccaacagttctggcatccgtatacagcactgccggcgtagagtgccctactgccctgaagatgccctgtgatttcattgaaaattctttccagattggtaacctctcagcccggctctctgtgccttatagatcatgagatctgtaacatacaacgtaacaattagcttctcagttcttgttggagaggctgggtttataagaaagaaagcagccaagcacatcagcccacgggagcctggcataaagtgtacctcagcagttccttagtgtttgtagaataaagtaatgtattatagctttcctatagatccacatggaagcctgagaagctatgtggttctcctcagacctcatagtctgctcagattcactcacttgggcgggttgtatagctctggggaagatttcacttctctgcctcagcaacacaggctcaggcgcatcctgctttgggttgtgaagttgaccggaagtgacacgtatagctttcagaaagaagtttgaagagccagcatgtgactgaccattcgtgcccttataccttgttttttccaaggattatgatagagccacaggccattgggtgctgatatttgttttcatggtgtaactaaatctgtccgcagagcaacacttcttttttatgaagataagaagtaactgaggcaggtttccaatctagacatggttactgtagggtctgctacttgctagcttcacccagctgaatcaagaagagaaaacaactggccaagcttgttgggggcatacatgaaagtctagtacttaggaggtggaggcaggaagataaggagtggaaggtcagtcttgggtgcatttgtgtgtgtgtgtgtgtgtgtgtgtgtgagagagagagagagagagagagagagacagagacagagacagagacagagacacagagagagacagagagagacacagagagagagagacagagagacacagagagagagagacagagagagagacacacacacacacacacagagagagagagagagagagagagagagagagagagagagagagatattccctggaatcaggctcccattacaagcactaacaattccatctgatgccttgcaaattgtttcagaggcctgggaaagataggaaaattttctgcctatttttagaaagccaatgtaacattgtaccaaaatcttataaagatagcattgaaaaaaaagaaaaccaacatccgatctcattgaaggagtaacaaatcctaaattattaaaataataacagttcagcaaagcattaaaatataccaagtgaagtccccttttgacaatcaacaacggcaccttaccccacacacattatgactgactgtgtacccctctaaaataggacgaagggggaaagaatgcattgcttcagaaaatgacccagcaacatatgctagttatctatttatttttcttgccttgacagaagctagctagtattatctggaagcagggaacaatgtctgttgagaacctgcctctgtccggattgaactgtcacaaggcaagtctgtgaaggcattttcttggtttaataattgatgtggtaggtccagccctctgtaggtggtaccacactgagtgtgtggtcctgggtcgcagggttaaggaacctgaacatgagcctggagaggaagccaggaagcagcactccttcatggcctctgctccacttcctgctttgagtttctagcttgaattctcttcatgaaaaattattggctgggctggcgagatggctcagtgggtgagaacactgactgctcttccaaaggtcctgagttcaaatcccagcaaccacatggcggctcacaatcatatgtaatgagattggacacgctcttctggtgtgtctgaagacagcagcagcatacttatttatactaataaataagtctttgggccggagcgagcagaggtcctaaattcaattctcaacaccagatgaaggcttacaactaactatctgtacagctacagtgtgtaatcatatacataaaataaataaataaatcttttaaaaattgaaaaattatttggtgtaaggtaaagaaacaaaaacccaaacaccctttccttttcaagtcgcttttagtcgtggtgtttatcacaggagctggaggccatgtaagatgcgtaggatgtagcatttagaagccatgtaggacacctcgtttagtggagctaagccactagtgtgatataagagtccgacgttaatagacggctttaccaaggaataatgaattctgtatttcaaacggagtcgggattggcttagggttaaaaagaacctagaagtcaaggttccccaggctggggtggctctgatagacgagtgccaagcacagctgcagatagcgcaaaagtatgacttaaaagatacatgctataaggaagaaaagtgagggaaaattgcaaaatatgaaaatagcaagaaatttcatgtatgtatcaagtttcccaaacaagggacaggcacacagtcacacagacacatagacacatagacacacaggcacacagacacacagacaggataggatattaagcactgcattttgttcctcttgttgaaaccctatgtagtttcattatgtaatccaggctgtcctccgactcatgctactccggactcagtttcccaagtgctggggtttcaggcacactgctaccttgtcccactgaaagagttgtgcctgagatggtcattacttagtgaaggacagtgagacttcagcaatggagatggcatccttgttagtggatttgtccacttaaatgcattagacaaagtctggcttatcatttattattattgttattattattattattattattattattattattattattttaagcatagagttagtgattactcattcctatactttcctattgttaaggaaaaaaatctaaaatggcaaaatcacaatgtgaaatacatatgcaaagatcttaaaaccaccagtccgtgagtaaaccagttccttttggagacaaaggaataggcagtaaataagagaaaaccacatttgttaatggatgggtagttgttcactctagccatggagacactgaatcagcactcgacacgattcctttacatacttacagaggacattgattcgtttctattgttactgagtagctccaacttcccaggtcacaagttgccaagagcagccaattattcttaagtttcaatttgttgaaaaaaaaaaaagccctgatagcattgatgttcatccccgagcaactcagtaactcagtgtgtgtgtgtgtgtgtgggggggggtgtgtgtgtgtgggagggtatgtctgtctgtgtgtctgtgtgcatatgtggacatacatatgccatgtcacatatgtggaaatcagaggacaacctgcaggagttagttctgttcttgaaccatgtggggttctgggaattcgagtcaagccattaggtttggtgtcaagagctttttcccgttgagccattttagcccatagaaactggttctaccacaaacatttacaagatacaaaagctaaggacactgcttagtccatttaaaatgatataggtcccaaagcttcgcttactgtgggattttctcctatcatctcatccctttctttcatctggtctttaggatccttttctgaaggtgtgaagttggtagagaagcctactgtgtggacaggaatgtctctcaaatgcatcaccattttgagtagtagtgattgagaacaaagggaattgttgtaaggtgtggagttatttgataaggtgtggttgtaacaaagcaccaaaactgggccagggagatagcttatcaggaaaagcacttggtacagcctcctgaatgccagagttggatccctggagtccacagaaaaagccgagtgtggaaagccagatgcagtgacaggaatttgtaacttgggcattcctgggaagagatgaaaggagaagatgggagaatggcctgaagcttaagggacagctatgggatgtgtgctacaagaacagaaactagggagactctgcctcaaagtggggtgggaaccaactacacacaggtatgttcaagcagacaccacacacacacacacacacacacacacacacacacacacacacacacacacacacacacattattaaagctgataacagcttttagactaagtagaaggaaaaagagataactgtagttaacaaaatctaattcccaatttgctacctacattccctacctgcagtatgctaactttaagagggaaaaagtcctccaaccagagtgtatataaaatatgttgtctgatcctcccaatagtggttttctaaaaggaatatcatagaagatatttagaagacttccttttacgttactttttgagacagggttttatgtaagccaagttgacctcaaactttgaatcccacttctctacttcctgagagctacagctataaatatgcaccatcatggctggtttacatggtgctggggacagaacccaggactttgtgatgctaggcaagttctctaccaactgaggtcgatccccagccctcagataacattgtgtggcgctattctgtctacccaagagagtttatagtttagacttccagatcaagcgaaataaagagttctggggagatgtccttttgcttcctagtgtaggtatagatgttacgggatggcaggatttagtcagaggaagagactcaacttctctgaaggtcttactatgcatacaactttctgctatggttcttatcctgtggcataaggacatcccctgccacccaattttacatgccacatcccaaatcattgtaacgaggcttcacatggcaaccagcagttgactgcaatgagacttccatggcaaccagcagttgactgtaacaaggcttccatggcaaccagtagttgactgcaacaaggcttccatggcaaccagcagttgacacctgccttgctctggttttgttacagctgaactgtttctcatctgtgaaacccctttttaaaacatgtattcatttatcttatatgtgtacactgtagttatcttcagacacaccagaagaggacatcagatcccattacagatggctgtgagccaccatgtggttgctgggaattgaactcagaacctctggaagagcagccagtgctcttaactgttgagtcatctctctggcacccccgctcccatgaaacccttttgcatatatctttttgtcttctagtcttgtggtccacaagccctacaagtcacttttggagttcttccttagccccactcccacattcttgctttggattatcttcgacattcagtgctctcagggcagctgtgaacctccttgaaaaattttctctcttgtctggtctctaatgatgtgtagacttgacttactaggggttcatgtcttgctctctctttcatgcagttcaattcatatttagcatcctaagtcagtgactatagggaaaggttttgagcccccttggaagtctctgctgcaagcatagatcttgcagagtagatatttaatgaactcttattaaatccatgcatgaatgaaactcttcatgtgtatttcccaatcttctctctacatcattgaaaggggaataacagaatttaaattcttcacaattcctgcaaagggagacttctactaagtatgaaatgtgcaaggcttgaatttgtaatgaatgtctgatgtaacccagcattcccagaatcaccacttgggttttccacaagggtatgcattcctcttttatacaaatgcatggagggggaggggttacaggataggcagaaatgaaagatatttgttaattttctgttattgtgataaaacactatgatcaaggaaactaatcgaagaaaaaagtttatgtggggttatggtggccgaggattagagtccatagcttgcaatggaggttgcaggtaaccagaacagaacaggctcacatccctgtcttcaagcaggaaacagaaagcatgcggagtggtgtaaggcattaaacctcaaaggccatcccacaggtcacacttcctatacctccccaaacagtgccaccaattgggaaccaaacatcagagtctgtggaggacatattcgttcaaaccaccaccacagacaagtagtttattctgtgcacccttcttatggaggaggctgacaagtaccactgtttacacacagtaggactgccacgaacaatatagccatactcactacctgctttcccggtttgtggccttcccatacctcacagaactttcttcttcctgcctgtacatttcactgctgtctcttgctgtggagtggggctctatatgtgcgagggtctcagtgtgaagcaggctctgtgctacttgtcttatcctgagttacagagattattttttgtcccagtccctatcaggagtcactattttgagcccaatctggtagctctggtttcttctttccagaatattctgagtcgcgcagcctcaaaccggctctgcctttcctctacatgcctgtgatgacgactgcctggctgcagatgctccgggtgttttcccacaccagtttctcttgttgtgactccatcaaacccaggtcagcttctgtaatcgagacgatccacttaattaactgtaatgaggctcccatcatttccaataaatttctttccaaaacaccacttgagaggcacatagcttcctatcagctgtaaattttttttttcctgtctatttagttccaggaattgaatttactcagagatgtcattgcccaacctcatgtctcaatgttttaaactaaatctttcagtctggtgctatgggctacaggacccaaccccagtttcccttgtacagaatggaagatgccgtgcaaacagcttgtctgggtttcaccagagctgggagaatcagtgctggttttcatggcctcttctgcgatcagccccttctccaccaacagttttgttagttagacagagcaacttgcgcttgaagatctcaaaccatttatcgaagcatgccatcttctcctttttaaagacctgaaatgctgttggaataattttgctgtgttttataaaaatatagagaggattaatacgtttggtagaggtgcaataaggtgtggagggaaggggtgcctccaaaggcctgtgctgaggcacctcttccccctgagcgaccagccaaagaatggtatagtatagaatagagtttattcatggcatggggaggggagttgagagagtagtagagacagagaaagagagagggagagagagaaagagagagagaggggggggagggagggaggaagggagagagagagagagagagagagggagggagagagagagagaagagtagtagaggctggtcatgagcatgtggagagagagggggaggggaatggggaatgggggagcaggagggagaggacagagtcggagcaagaaagcaagagagaacagaggggctaagcagtcccccttttttcattttaaaaattttattagatattttctttttttacatttcaaatgcttcctataccctcccctcgccctgctcccctacccacccatagcagccccttttatagtgagtcaggcacacctggctgttgccaggtaactggggcagagcctatacaaaaatgctaacagatttgtcagtgaaatgatattttgctctttgacttatagaagatgaaaaagaaaaccacaagtttcatactgaccctttggggaggatacatctttaagaaattatgggagagaatagtttcatttagaaagaatttaagtgtttttttttcccctctcagacatgtcatggtttaatatcagttatccaatttttctttgtgctactctcagaattcttcctgagaaattagctttaatcttctgctttgtttcaaagcctgcactagattaagcctcgtcctctctctctctcctctctctttctctttggcttcattcgggaatgactaattagccaggagaaattaaatttacaaattaaacctctctgcatagattttctcaagaccccagccctgggggtaatatccatggcctctcctacagagcttttgcctcccagagggttgtatagaggggtgaaatgtttatgaagccacatcggcttgaagagcaggttggtggttggcggttggcagcattataagttgttctttggttccttcagggaaaaacttcagtgttccaaagttcagggtcatggaaggagggtgaggaatgttcccagccagagaagaaagtgatgtgtgtgagagagaactgccgagaactgtagaactgaagtttccaccgctccaattacatgcctgaatgccttcttttcatttcatctctgtttattatctttgtctgtgtgtggatggtgtatatatggtatgtgcatttatgtgtgtgagtgtacacttatgcatataaattcaagtgctcatgttttactccacgtataaagagatcagaggacagccttgggtattgttcattgcctttcacctttctctttctctctcttgaatacaccacctatcattgtaggagactggcatcacagacctgccatggctggctttgtatgggatgcagggatgtgaatccaggtcctgatgtctatgtggcatagacacttaactaggaccccaacccattcacctcccaagcctgactctgctcccctgctccactctacaacatgccctctactcgataaaggcactaaaatgtgtgactaggggccatccagtttgttctgagtgtcagctcatgcctccttcttaggaagcatttcaagccaatgtctcttaataccacccacggttcattgttttctggcttctccttccttccttccttccttccttccttccttccttccttccttccttccttccttcctcccttcctcccttcctcccttcctcccttcctcccttcctcccttcctccctttctcccttccttgctttttctttctaacatcttttgtgtattgaaaatgctgatgtttttgctatttggggatgagctcttgcaggatagtgttccccaactcttctcttccaagtttattctccagatctttgcattaagttaggcaggctcctttagggacagagaccgacggcttactggaggggaaggcttcagtcccattaaaagatggttaatgaacattcaaagttagtgtttctctttgtttcagctgcagatcttttggagaatcttaggagaaagcagccaagaccactgaatccacctgacctcattaacctggagcaaactgggcttattagaatttagattgaaggcctcagaggttagatattgctcttggagaagacctaggttcagttcctagcacccacataggtcggattacaattgctgataactccagttccaggggatctgtcactttcttctgaccttccaggtcttcatgcacattgtgcacatacagacaagcacacgcacacacacacacacacacacacacacacacacacacacacacaaatattaaaactctggagtgtgaacttagtatgcccataggtaattatgtccattagctttcctcattggacattttctctgtcacctttaactcaggatgctcacaaatatccctacccctctacgtacttcctttatgaatttgtatatgccccttcccttgtttggggagcagatgtttctctactctttgatctgactgttgtgctcactggtttcatactcaccaagagacctgattcgacttaggtaccgagtcacccacgtctctcagggtcagcctgctctgtctctcagtttttggtctaagaaaacaaggccttccacccttttgatcagcagatatgagtaaaagaaataaaagttgatgctctttgttttccagggattcagataaaatgtttgccatatgcatgaaataatttttaagaggtaggttggttcttccccctaaagcaaggtttatctaagaagagtgcttttaaggatggtcgtgatgctgacagtacctcgcattcctaccgtcatttctggaaaagccattttaatttttcatctcacctcgccatctgggagacaagtgaactcaatgttttccttgccatttataaagtgagttagttaagactcgggtaagactattgatctgcaccaagatccaataccaggaaaagagatgaaattggtatccaaacttttgtttcaggactctgagccctggcctctattgtctcaaacacagttcaatcataaactgagtcaatacatctagcactgcctggcagtataaggcaattaaactatcacaaggctatgggggtaaagacactatcacaaaggtctgggataaataaacttgaacaggttgataaagtgtgggactcaatctctaaaggaggtgctgtaatctctctgtagtggaaggtttacctgaaggaacagatttgaagttattcctgaaagcatactaaaaccagaagacagtttggcagtccgaatcaaaaactttaactaaagacatgaaccacagtactttccagcatatcactcagtggctctaaagttcttttccttgtttgaaaacaatagagtccaggggaggattaaatggtgatttgtaaagtgccaggctcagggcacattcagtaaatgttaccagtgattgcagaataatggtgataatattttcctttgtaggaggaaataatgagcacgtagatttagcaacacacagatcgtttgttgtgcttttaaaagtcacagtgaaaagttggaaacaacttgatgtccagcaagagggaattgcagaagagagtttcctggtatttctaggtgctagatcattagatagccatgtaaaagaataaaaggaaataaatatgttattgcctagcaagatggccatgaatttgttgttgttgttgttattaagacagggtttctctctgtagccctggctgacctagatctatagaccaggctggcctcaaactcaaagatcgatctgcatctgcctcctgagtgctggggttaaaggcttccaccactgctgcctggctataaatgtttaaaatatattttctattaattcttcacaaattccatatatgtgtacagtgtattttgaccatattcacccctactcctcttcccaacccctttcagctcccctgctgccatatttccatcccttaccaattttgtgtactatttaattaatagatatatacatatatatatttaattctgatatatcagcacattatatattatattatattatatgttacatatattatctgttacataatatacatgtatacatgtatgtatatatatatatatatatatatatatatatatatatatatatatatacatattgatgtacacccattcattggagtctggatgccttgccagggaccactcttaagcaaagtggcctctccctgatctggaagtcccttgactgttaacagatccttagctagggctggagacttgggagccccatgcctctctaagcaggaatcctgacttggtcttgggctgccactgtgagctcatgaggcagtgttgggggagggatgctttataccatcccctttgtgactgagaattccacaaatgctcattctctgcacttggcagtgattttttacctttcaaaaacacttataaaatattaaatcctttttttttaagtttgtgcttttttgatgttgtttaacacatatattcatgtacagatacaggatagctttaaaaactaggagatgaatttgcagctctatgtcaacaaaactgacatttaaaaattgtttttattaaaattctttttatttaaactatcccagtaacaaaggcaagtatcatgtaaaataaaattgtgctgttttgttttgtttctggctttcttgtttcctactctttcctttggtttgtcagctctgtgctaccataagcagacacgatccattcaatagttgactaacagcattcttttgagtgtttactgtggccaaggccctggttctaagcacttgatgtacagataaaccagatgaacaacaatgcccttcaaaagcttaaattcaaggctggagaaatggctcagtggttaagagcactgtctgctcttccagaggacccaggtttgactcccagctcccacatggcagcttataaccatctacagctccagtcctgggaggtctgacactctggtacccacgtggtacatataaatatatgcaagcgagacatgtgcacatataattgaaatataggtatagtgatcttgggattccagtgtctgaagcaggagaaggatgagactgagatcagcctggaataagatcctcttttgattaaaacaaaagcatgtactaggtgacatgaacagcacaaccgcaagagaaggagagtagaccaaaatttctagaggagctatgccttcttaacagcattcaacccctcttctgagaatccctgcagactgccctccagcatcactgatttccatagaggctgcatagctgtcaaagttcacagtctactcagaggtaacctgctgtgtcaatatttgtaatttgtacttcatggtgagtcacttccagagaatagattatctaccatggaagggaaaaggtctgggagtgaaagtgagctggacaagacacaggtggaggcattaggtttcaacagcttcctgcctctacaaagcaaagggcaggaatgtgtgctggcgtgggctggagcccagaacagccacaactctcaagtggaggataagcagaaagcagggttagtctcctgtttctccaggtggttctagctgattcttctaggtctggaaacaaatgttaccttctatccattttctctccttctcccctggcttccatttttatagctcagaagcaaatccatcttttaagagttgttctcaagcaatctttgtctaaagctggatcctcaccatactacatcccacttcacccccacctccaccctcactgccaattgaggaagttctctgaattctgacacctccatagcatgtgatagtcccctatgttattcctatgcatcaattcatttttacattgtgctggagaactccatctctcttacaagagtagatgatcattaaggtttggtctatagaactccaaatagactggactagaaaagaaattccttctgacacataataatcagaacaacaaatgcactaaataaagacagaatattgaaagcagtaagggaaaaaggtcaagtaacatataaaggcaggcctattagaattacaccagacttctcaccagagactatgaaagccagaagatcctggacagatgttatgcagaccctaagagaacccaggccaggctactatacccagccaaactctcaattaccatagatggagaaaccaaagtattccatgataaagccaaattcacacaatatctttccacaaatcgagcccttcaaaggataataaagggaaaacaccaacacaaggacagaaactacaccctagaaaaagcaagaaaataatctttcaacaaacctaaaagaagactgcagcaagaacagaatccaaactttaacaacaaaattaacaggaagcaacaattacttttctttgatttctcttaacaccagtggactcaattgcccaatgaaaagacatagactaatagactggctacacaaacaggacccaacattttgctgcttacaggaaacccacctcagggaaaaagacagacactacctcagagtgaaaggctggaaaacaattttccaagcaaatggtctgaagaaacaagctggagtagccattctaatatcgaataaaatcgacttccaacccaaagttatcaaaaaagacaaggaggggcacttcatactcatcaaatataaaatctactaaggtaaattctcaattcttaatatctatgctccaaatataagggcagccacattcattaaagaaactttagtaaagctcaaagcacacattgcacctcacacaataatagtgggagacttcaacacctcactctcaccaatggacagatcctggaaacagaaactaaacagagacacatggacactaacagaagttataaaacaaatggatctaatagatatctacagaacatcttatcctaaaaaaaaggatataccttcttctcagcacctcatggtaccttctccaaaattgaccatataattggtcacaaaacaggcctccatagatacaaaaatattgaaattatctcatgcatcctacctgatcaccacggactaaggctgatcttcaataacagcataaataatagaaagccaacattcacgtggaaactgaacaagactctactcaatgattccttggtcatagatgaaataaagaaagaaattaaaaactttttagagtttaatgaaaatgaagccacaacatacccaaacttacgggacacaatgaaggcagtcctaagaggaaaactcatagccccaagtgcctccaaaaagaaactagagagagcatacactagcagcctgcagcacacctagaagctctagaactaaaggaagcaaattcacccaagaggagtagatggcaggaaataatcaaactcagggctgaaatcaaccaagtggaaacaaaaagaactattcaaagaatcaaccaaaccagaagctggttctttaagaaaatcaacaagatagataaacccttagccagtctaactagagggcacttgtatccagtctaactagagggacagtatcctacttaacaaaatcaaaaatgaaaaaggagacaacaacagatcctgaggaaatccaaaacatcatcagatcctaccacaaaagtctatactcaacaaaactagaaaacctggatgaaatggacatcttcctaggcagataccaggtaccaaagttaaatcaggattagattaacgatctaaacagtcccatttctcctaaagaaatagaagcagtcattaataggctcccaaccaaaaaaaaaaaaaaaaaaaaccaggaccagatgggtttagtgcagagttctatcagaccttcaaagaagatctaattccaactctcctcaaactattccacaaaatagaaacagaaggtactctaccaaattcattctatgaagccacaattactcttatacctaaaccacacaaagatccaacaaagaaagagagcttcagaccaacttcccttatgaatatccatgcaaaaatactcaataaaatccttgcaaaccgaatctaagaacatatcacaatgatcatccatcatgatcaagtaggcttcatcccagggatgcagggatggcttaatatacggaaatccatcaacataatccactatataagcaaactcaaagacaaaaaccacatgatcatcttgttagatgctgagaaagcatttggcaaaatccaacaccccttcatgataaaagtcttagaaagatcaggaatttgaggcccatacctaaacataataaaagcaatatacagcaaaccagtagccaacctcaaactaaatggggagaaactcaaagcaatcccactaaaatcagggactagacaaggctgcccactttctccgtacttattcaatatagtacttgaagtcctagccagagcaattagacaacaaaaggagatcaaggggatacaatttggaaaggaagaagtcaaaataatcactatttgcagatgatatgatagtgtatatataagtgatcttataaattccaccagagaactcctaaacctgataaacaccttcagtgcagtagctggatataaaattaactcaaacaaatcaatggcctttctctacacaaaggataaaagggctgagaaagaaattagggcaacaacacccatcacaataggcacaaataatataaaataccttggtgtgactctaactaaggaagtgaaatatctgtatgataagaacttcaagtctctgaagaaataaattgaagaagatctgagaggatggaaagatcttccatgcaggattaattggcaggattaatatagtcaaaatggctattctgccaaaagcaatctatagattcaatgcaatccccataaaaattccaacataattcttcacttagttagaaagggcaatttgcaaattcatctggaataataaaaaacataggatagtaaaatctattctcaacaataaaacaacctctggtggaatcaccatacctgaccttaagctgtactacagagcaattgtgatgaaaactgcctggtactggtacaatgacagataggtagatcaatggaatagaattgaaggcccagcaatgaatccacacagctgtggtcactggatctttgacaaaggagctaaaaccatccagtggaaaaaaggcagcattttcaacaaatggtgctggcacaattggcggttaccatgtagaagaatgggaattgatccattctttttttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcggcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctctaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcgattttcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacagttgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagagagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatacttcttcttgtttccacttggttgatttcacccctgagtttgattatttcctgccgtctactcctcttgggtaaatttgcttcctttttttctagggcttttagatgtgttgtcaaggtgctagtatgtgctgtctctcgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtcgatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggaatcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccacgcgattggattggggtaggcgctgtgttccactcaccagaggtcttagggtcccgtggggagtcccgtgtggacccttgcgggtgttgggcaagactctgctggcaaggtagcccggggctcgagtctcgagtcgagcagaagggacttgtgccccagatcaggcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcaggcccgggtagcctgcttccctatgtaccgcagtctcaagttccgcgcgattggattggggcaggcactgtggtccactcaccagaggtcttagggtcccgtggggagtcccgtgtggacccttgcgggtgttgggcaagactctgctggcaaggtagcccggggctcgagtctcgagtcgagcggcgaattgatccattcttatctccttgtacaaagctcaaaagtaagtggattaaagacctccatataaaagcagagacactgaaatttatagaggagaaagtggggaaaagcctcgaagatatgggcacaggggaaaaattcctaaacagaacagcaatggcttgtgctgtaagatcaagaattggaaaatggaacctcacaaaattgcatagcttctgtaaggcaaaagacaccgtcaataagacaaaaaggccaccaactgattgggaaaggatttttaccaatcctaaatctgatatgggactaatatccaatatatacaaagagctcaagaagttagactcccgaaattcaaataatcccattaaaaacggggtacagagctaaacaaagaattctcaagtgaggaataccaaagggctgagaagcacctgaaaaaatgttcaacatccttaatcatcagggaaatgcaaatcaaaacaaccttgagattccacctcacaccagtcagaatggctaagatcaaaaattcaggtgacagtagatgctggcgaggacgtggagaaagaggaataatcctccattgctggtaggattgcaagcttgtacaaccactctggaagtcagtcttgtggtttctcagaaaattggacatagtactgctggaagatccagcaatacctctcctgggtatatacccagaagatgttccaactggtaataaggacacatgctccactattttcatagcagtgttatttataatagccagaagctggaaagaacccagatgtccctcaacagaggaatggataaagaaaatgtggtacatttattcaatggagtactactcagctatttaaaacaatgaatttatgaaattcttgggcaaatggatggatctggaggatatcatccttagtgaggtaacccaatcacaaaagatttcaccagatatgcactcagataagtggatattaacctagaaacttagaatacccaagatacaacttccaaaacacaagaaaatcaagaagaaggaagaccaatatgtggatacttagaataaggaacaaaatagccatgaaaggagttatagagatgaagtttagagttaagacaaaagggtggactatccagagactaccccatcttgggatccatcagccactaaacccagatactattgcatatgccagcaagattttgctgaagggaccctgatatagctgtctcatatgaggctctgccagtgcctggcaaatacagaagtggatactcacagtcatctattggatggaacacagggcctccaatggaggagctagagaaagtacccaaggagctgaagggatctgcaaccctatagatggaacaagaatatgaactaaccagtacccccagaggtcatatctctagctgcatatgtagcagaagatggcctagtcggccatcagtgggaagagaggcccctaggtcttgcaaactttatatgccccagtacaggggaacgccagagtcaagaagtgggagtgggtgggtaggggatcagggtcgggagagggtatagggaactttcgggatagcatttgaaatgtaaataaagaaaacatctaataaaatagcaataaagaataaccactacaaagagagaaaaggacaacaaaagcctgcagtaagtttgctagctgaacagagcagatgaataaccggcagcagactttgcaccacatcatttcctttggccatccgcacagattgccggaacaggcaaaccagatctccatgcattctgttgtccccaccctctgggccataggacttggacaaaggtaatgtcctggatctgaaagaagttaagacactgggatggtatttaattaaataataacagaggctcaactcggtgattggcctggctggaccagcctgatgtgttgataattgtctaatcctctagtggatatcaaaaaaaatcattgctttcccaagggaaggggacagccaggagaaggagaggtatacatggatgataaacgttccagatactggctaagtgcttaccagtaaattgaagtccacatttcacagcatactccaggaagtcatttctccccagccagactcaacagtctttgaaggcttctaaagtccagctgggaggtagtgttgagcctctagcatgtctattcatagactactagatcccatgagagctgccattacaattgctggagtacattttttcacttcctatcacctaaataaacttcacccactgtgtgggtttgctaatcccttcctcatccttgctgtatccaccaccctgtcttgtttccttagcaactagacactgctgagggcagggcagaaggctaaaagggagcaccagtaagtggaatgagtgagtggtggcttggtgggctgcagaggggttagttctcacgttgcctttttgagtattccccatcattttctcttctagtgcgcaagtgcagggtcctcacatctatccacactgtccacacagagagaacacatttttaaaagctagcccaaagagagaacaaagagctgaggataactattcctaacccaggatgtctgccttacattactttttaggtactttgcatttgtttgctgctactatcattgtttgtttactatattttaggagttcgaacaatcccaggcaccattcagacagaaagtggcaaatgtcatctaaaagggcagggcttaacattcccgtggcagtgtgtgcttccccagtcagagagagcactttcttgcttttactgttttctaactcgagatttcccccgcttttctggagcttttttttttttgttgtttagcttctcatcaagaaagtataagttgtaggctgcgggagtgtctgtggggatgcgtttgttttgtttttgagacagagtttggctatttagagaaggctagctttgaactcccagagacccacctgcttgtctcaagtgctggcactgaaagtatgtgtccacatacctggcctcgtgtactaattttttgataattacaaaaaagggcaagaaaaaaagaaagaaagaaaatttctttcttcagccattcattctgtagcctgttgtgtccaacactgatctaggcattcttttggggtacttgagcagaaagactagactgtgtactttctagctgggctcttcaccagcaggtgcacatttcagtatttatttggccacttgaaaatctcactgttgattttgtgataaaaaaaaaaaacaaaacccaggaacttatttgtaaaacgattattcctggtgtttatctgactcaccttatcatctgtgtttaaagattggtggggtacactctgagctatttgtacttggcaagatccccaactctgagagcaaggttttagctggctagttttcctccttcagcctctgccaagtgcttggtcctctagagaataatatgtaccttttgtccccacatattaaatacaaataaagagaagaacatgtcatcttgaggcattggaagctattaaggctatctcaggcaatctggacaactctacgccttggtcacatagtggcttcttaatatgtaccatggctcactcaagaaaaatggagtggtgaccaacttcagcctctgagttttgagatggagactctgagatagctgtcaatattttgtaaaactgcttcctaacatcccgtacccctttctgtatgtatatctgcatgcacatgcacacatatgggtatagagcccgcactggccaaaagatgagagcagatctccctggatccagaattatatatggttgtgagcttccctatattgctgctgagagccaatccagttctctggaagagcaatactcactctcaactgctcagtcgcctctacaaaccaactgttttttgtttgtttgtttgtttgtttgtttgtctgtttggtttggtttggtttctcttagacagggtctctgactgggaccgaggcttgctgagtagggtaggctatttgaccagcagccctcaggaatgcaagtattttcctcaacatctgatttcctctttcctttctccctccctccctccctccctccctccctccctccctccctcccttccttaatttcttcctttcttctttctttcttcctccttccccctctcttcccctctctctctttctttttttccattgccgacatgaagaagtagagatgagcatgaccaaggtcagtttctgcttttcctgtgacaagggttctccccagtcaaccctggtctgcccacagaattcttatcccactgaaaggaatagacatttccctacatgaagagttgtaaagtggtggttggtcccattgcatgcacagagagtgagagacgggtaacctgtgagacacctcctacataaaaagagttccagtgatcttcaaagtgtttgtcactcacccagaaaaactccagctcctcactaccaagcctaggaaaggaagacagaaatacctagagaggaattccaatcacctcaagaaaaatggagtagtgaccagcttcagcctctgagttttgagatggagactctgagagagctgtcaatattttgtaaaaccgtttcccactcgatagcattcccagagtgaaggtttttctctcctcagccatgagctaggcttctggatttctacatcctgtttcatttgtgttcttcctcctatatttaagtgtaagcttgaatgagcgtctcagttcacttcccacaatacgagaatttcccaaacaaggagggcacaccaaactcatgttagcagtgcctcttcaggtgttgcccatttttctccttcaaaagtccccaagcctcccaggtactactttgccagttcaggttgttcaggggaggtacaccaagtgctgattcccactgagctcctactgaccctattcagtattgtgccacagtttacccttctcttctcttctcttctcttctcttctcttctcttctcttctcttctcttctcttctcttctcttctcttctcttctcttctctcctctcctctcctctcctctcctctcctctcctctcctctcctctcctctcctctcctctcctctcctctcctctcctctcctttcccctcccctcccctccccctcccctcccctcccctccccctcccctcccctcccctcccctcccctcccctcccctcccctcccctcccctcccctccttttcttttcttttcttttcttttcttttcttttcttttcttttcttttcttttcttttcttttcttttcttttctttgtgataggcttgggaagcttcccctgcaggactgtggagctcttgtgttcacatttgtgccttttggaaagatgcttcagcggctggacccgaggcaagagtttgtcttcaaaatgctgccattgcctctgtcagttttcatctgcctgtaaactttttttttttctttttgccaaatctcctgaagcaacttgacctcaaggttttttttttttaattccctcaactctttctttattctttgttccattttcactatcttttttttcttattagttaagagaaaccaaagaattgattcacctgctcattagttttctcgaatattcccctgtgactaaagtaaaactaggctacacccctaagagaaagatgcctcttagggctcctgtcatcttcctattgtcttgactggtgtgcatacaaagtttgaactatgaaactagggcatggctgattttggctccagtgtttacttgtgaaccagtctattcactattgacctagctttcagattccacagcccttctagcttccctaacataaaaacataagcattatatgtatttaggaagtatcatgttgtgttccaataatatttatgcagtttgacctcagttgtgcccttaatccttgtagtacctgttttagttagggttttactgctgtgaacaggcaccatgaccaagtcaactcataaaaacaacatttagtttgagctggcttataaattcagaggttcccaccaatgtcatcaaggtgggaacacgatagtgttcaggccgatatggtgcaagaggagctgagagttgtacattatcataggaaggctgctagcagaatagtgacttccgggcagctaggatgaagatcttaaagcccacacccacaagagcacacctactccaacaggaccacaccttctaatagtgccactccctgggccaagcatattcaaagcatcacagtatcttaattagaaaagtgggagctatcccttgttcatctgtcttagttgtcttgactgctataacaaaacacctcaaactcattcattcacaaag

SEQ ID NO: 17 - DNA, 3294 bp, Artificial
  Synthetic
atggggacccgggcaagcagcatcaccgccctcgcctcttgcagccgcaccgccggccaagtcggagccacgatggtcgccggctctcttctcctgcttggattcctcagcaccatcacagcttggtacattctggtgccaagtgtggccattcccctggctatcgccttcctcttcttcttcatctgtgtgtgccgcaataaccagaagtcttcatcaggtaccgatttaaatgatccagtggtcctgcagaggagagattgggagaatcccggtgtgacacagctgaacagactagccgcccaccctccctttgcttcttggagaaacagtgaggaagctaggacagacagaccaagccagcaactcagatctttgaacggggagtggagatttgcctggtttccggcaccagaagcggtgccggaaagctggctggagtgcgatcttcctgaggccgatactgtcgtcgtcccctcaaactggcagatgcacggttacgatgcgcccatctacaccaacgtgacctatcccattacggtcaatccgccgtttgttcccacggagaatccgacgggttgttactcgctcacatttaatgttgatgaaagctggctacaggaaggccagacgcgaattatttttgatggcgttaactcggcgtttcatctgtggtgcaacgggcgctgggtcggttacggccaggacagtcgtttgccgtctgaatttgacctgagcgcatttttacgcgccggagaaaaccgcctcgcggtgatggtgctgcgctggagtgacggcagttatctggaagatcaggatatgtggcggatgagcggcattttccgtgacgtctcgttgctgcataaaccgactacacaaatcagcgatttccatgttgccactcgctttaatgatgatttcagccgcgctgtactggaggctgaagttcagatgtgcggcgagttgcgtgactacctacgggtaacagtttctttatggcagggtgaaacgcaggtcgccagcggcaccgcgcctttcggcggtgaaattatcgatgagcgtggtggttatgccgatcgcgtcacactacgtctgaacgtcgaaaacccgaaactgtggagcgccgaaatcccgaatctctatcgtgcggtggttgaactgcacaccgccgacggcacgctgattgaagcagaagcctgcgatgtcggtttccgcgaggtgcggattgaaaatggtctgctgctgctgaacggcaagccgttgctgattcgaggcgttaaccgtcacgagcatcatcctctgcatggtcaggtcatggatgagcagacgatggtgcaggatatcctgctgatgaagcagaacaactttaacgccgtgcgctgttcgcattatccgaaccatccgctgtggtacacgctgtgcgaccgctacggcctgtatgtggtggatgaagccaatattgaaacccacggcatggtgccaatgaatcgtctgaccgatgatccgcgctggctaccggcgatgagcgaacgcgtaacgcgaatggtgcagcgcgatcgtaatcacccgagtgtgatcatctggtcgctggggaatgaatcaggccacggcgctaatcacgacgcgctgtatcgctggatcaaatctgtcgatccttcccgcccggtgcagtatgaaggcggcggagccgacaccacggccaccgatattatttgcccgatgtacgcgcgcgtggatgaagaccagcccttcccggctgtgccgaaatggtccatcaaaaaatggctttcgctacctggagagacgcgcccgctgatcctttgcgaatacgcccacgcgatgggtaacagtcttggcggtttcgctaaatactggcaggcgtttcgtcagtatccccgtttacagggcggcttcgtctgggactgggtggatcagtcgctgattaaatatgatgaaaacggcaacccgtggtcggcttacggcggtgattttggcgatacgccgaacgatcgccagttctgtatgaacggtctggtctttgccgaccgcacgccgcatccagcgctgacggaagcaaaacaccagcagcagtttttccagttccgtttatccgggcaaaccatcgaagtgaccagcgaatacctgttccgtcatagcgataacgagctcctgcactggatggtggcgctggatggtaagccgctggcaagcggtgaagtgcctctggatgtcgctccacaaggtaaacagttgattgaactgcctgaactaccgcagccggagagcgccgggcaactctggctcacagtacgcgtagtgcaaccgaacgcgaccgcatggtcagaagccgggcacatcagcgcctggcagcagtggcgtctggcggaaaacctcagtgtgacgctccccgccgcgtcccacgccatcccgcatctgaccaccagcgaaatggatttttgcatcgagctgggtaataagcgttggcaatttaaccgccagtcaggctttctttcacagatgtggattggcgataaaaaacaactgctgacgccgctgcgcgatcagttcacccgtgcaccgctggataacgacattggcgtaagtgaagcgacccgcattgaccctaacgcctgggtcgaacgctggaaggcggcgggccattaccaggccgaagcagcgttgttgcagtgcacggcagatacacttgctgatgcggtgctgattacgaccgctcacgcgtggcagcatcaggggaaaaccttatttatcagccggaaaacctaccggattgatggtagtggtcaaatggcgattaccgttgatgttgaagtggcgagcgatacaccgcatccggcgcggattggcctgaactgccagctggcgcaggtagcagagcgggtaaactggctcggattagggccgcaagaaaactatcccgaccgccttactgccgcctgttttgaccgctgggatctgccattgtcagacatgtataccccgtacgtcttcccgagcgaaaacggtctgcgctgcgggacgcgcgaattgaattatggcccacaccagtggcgcggcgacttccagttcaacatcagccgctacagtcaacagcaactgatggaaaccagccatcgccatctgctgcacgcggaagaaggcacatggctgaatatcgacggtttccatatggggattggtggcgacgactcctggagcccgtcagtatcggcggaattccagctgagcgccggtcgctaccattaccagttggtctggtgtcaaaaataataataa

What is claimed is:

1. A genetically engineered mouse comprising in its genome a modified endogenous DR6 locus comprising a replacement of the endogenous genomic sequence comprising part of exon 2 to the entirety of exon 6 with a heterologous polynucleotide comprising an ROR1 transmembrane domain encoding sequence operably linked to a β-galactosidase gene such that the locus (i) lacks a nucleotide sequence encoding amino acids 1-614 of SEQ ID NO:15 and (ii) comprises a nucleic acid sequence set forth as SEQ ID NO:17, or a degenerate variant thereof, operably linked to endogenous DR6 transcriptional regulatory sequences, wherein the mouse is homozygous for the modified endogenous DR6 locus, and
wherein the mouse expresses the nucleic acid sequence and develops (a) dysfunction of motor neurons that presents as one or more ALS-like symptoms, (b) motor neuron loss in the spinal cord, (c) diminished nociception compared to a control mouse, or (d) any combination of (a), (b), and (c).

2. The genetically modified mouse of claim 1, wherein the mouse exhibits dysfunction of motor neurons that presents as one or more ALS-like symptoms.

3. The genetically modified mouse of claim 2, wherein the motor neurons comprise upper motor neurons and lower motor neurons.

4. The genetically modified mouse of claim 3, wherein the dysfunction of motor neurons is not apparent in a blinded subjective neurological scoring assay, rotarod test, catwalk test, open field test, and weight measurement until the rodent is more than 4 weeks old.

5. The genetically modified mouse of claim 1, wherein the rodent exhibits diminished nociception compared to a control mouse.

6. The genetically modified mouse of claim 1, wherein the mouse is from a strain selected from the group consisting of a 129 strain, a C57BL/6 strain, and a mixed C57BL/6×129 strain, and wherein the mouse exhibits reduced weight gain compared to control wild-type animals between 8 and 20 weeks of age.

7. A mouse cell or tissue comprising a modified endogenous DR6 locus comprising a replacement of the endogenous genomic sequence comprising part of exon 2 through exon 6 with a heterologous polynucleotide comprising an ROR1 transmembrane domain encoding sequence operably linked to a β-galactosidase gene such that the locus (i) lacks a nucleotide sequence encoding amino acids 1-614 of SEQ ID NO:15 and (ii) comprises a nucleic acid sequence set forth as SEQ ID NO:17, or a degenerate variant thereof, operably linked to endogenous DR6 transcriptional regulatory sequences, wherein the mouse cell or tissue is homozygous for the modified endogenous DR6 locus.

8. The cell or tissue of claim 7, wherein the cell is a motor neuron or an embryonic stem cell.

9. A method of making a genetically modified mouse according to claim 1, comprising the step(s) of:
replacing, at the endogenous DR6 locus of the mouse, the genomic sequence comprising part of exon 2 through exon 6 with a heterologous polynucleotide comprising an ROR1 transmembrane domain encoding sequence operably linked to a β-galactosidase gene such that the locus comprises (i) a deletion of an endogenous nucleotide sequence encoding a mature DR6 protein, wherein the endogenous nucleotide sequence encodes amino acids 1-614 of SEQ ID NO:15 and (ii) a nucleic acid sequence set forth as SEQ ID NO:17, or a degenerate variant thereof, operably linked to endogenous DR6 transcriptional regulatory sequences, and
breeding the mouse to homozygosity for the modified endogenous DR6 locus.

10. A method of screening a candidate agent for modulating motor neuron dysfunction comprising:
(a) administering a candidate agent to the mouse according to claim 1, wherein the mouse develops motor neuron dysfunction; and
(b) determining any modulatory effects of the candidate agent on at least one symptom of the motor neuron dysfunction in the mouse compared to a test control mouse;
wherein the presence of a modulatory effect on the at least one symptom of the motor neuron dysfunction in the mouse compared to the test control mouse is indicative that the candidate agent is useful for modulating motor neuron dysfunction.

11. The method of claim 10, wherein the agent is administered prior to detection of the symptom by blinded subjective ALS-TDI neurological scoring, rotarod testing, catwalk testing, open field testing, measuring weight, or determining the latency to respond to a painful stimulus.

12. The method of claim 10, wherein the agent is administered after detection of the symptom by one or more of blinded subjective ALS-TDI neurological scoring, rotarod testing, catwalk testing, open field testing, measuring weight, or determining the latency to respond to a painful stimulus.

13. The method of claim 10, wherein the agent is administered at two or more different time points.

14. The method of claim 10, wherein the at least one symptom is selected from weight loss, and deficient sensory perception compared with a control mouse that has a strain identical to the mouse but does not comprise the nucleic acid in its genome.

15. The method of claim 10, wherein the at least one symptom results from an upper motor neuron dysfunction.

16. The method of claim 15, wherein the at least one symptom is selected from the group consisting of tremors, spastic paralysis (rigidity), abnormal reflexes, and a combination thereof.

17. The method of claim 10, wherein the at least one symptom results from lower motor neuron dysfunction.

18. The method of claim 17, wherein the at least one symptom is selected from the group consisting of muscle weakness and wasting, fasciculations, and a combination thereof.

19. The method of claim 10, wherein the at least one symptom of motor neuron dysfunction is reduced weight gain.

20. The method of claim 10, wherein the at least one symptom of motor neuron dysfunction is diminished nociception.

21. The method of claim 10, wherein the mouse is from a strain selected from the group consisting of a 129 strain, a C57BL/6 strain, and a mixed C57BL/6×129 strain.

* * * * *

UNITED STATES PATENT AND TRADEMARK OFFICE
CERTIFICATE OF CORRECTION

PATENT NO. : 10,285,387 B2
APPLICATION NO. : 15/072286
DATED : May 14, 2019
INVENTOR(S) : Burcin Ikiz et al.

Page 1 of 1

It is certified that error appears in the above-identified patent and that said Letters Patent is hereby corrected as shown below:

In the Claims

Column 43, Line 9 in Claim 3:
"motor neurons comprise upper motor neurons and lower"
Should read:
--motor neurons comprise upper motor neurons or lower--.

Signed and Sealed this
Twentieth Day of August, 2019

Andrei Iancu
*Director of the United States Patent and Trademark Office*